United States Patent
Takahashi

(10) Patent No.: US 9,758,594 B2
(45) Date of Patent: Sep. 12, 2017

(54) STABLE MULTIVALENT ANTIBODY

(75) Inventor: Nobuaki Takahashi, Tokyo (JP)

(73) Assignee: KYOWA HAKKO KIRIN CO., LTD., Tokyo (JP)

( * ) Notice: Subject to any disclaimer, the term of this patent is extended or adjusted under 35 U.S.C. 154(b) by 345 days.

(21) Appl. No.: 12/989,600

(22) PCT Filed: Apr. 27, 2009

(86) PCT No.: PCT/JP2009/058249
§ 371 (c)(1),
(2), (4) Date: Oct. 25, 2010

(87) PCT Pub. No.: WO2009/131239
PCT Pub. Date: Oct. 29, 2009

(65) Prior Publication Data
US 2011/0076722 A1 Mar. 31, 2011

(30) Foreign Application Priority Data
Apr. 25, 2008 (JP) ................................. 2008-115463

(51) Int. Cl.
C07K 16/28 (2006.01)
C07K 16/00 (2006.01)
C07K 16/46 (2006.01)
A61K 39/395 (2006.01)

(52) U.S. Cl.
CPC ...... *C07K 16/468* (2013.01); *A61K 39/39591* (2013.01); *C07K 16/2818* (2013.01); *C07K 16/2878* (2013.01); *C07K 2317/51* (2013.01); *C07K 2317/56* (2013.01); *C07K 2317/622* (2013.01); *C07K 2317/624* (2013.01); *C07K 2317/626* (2013.01); *C07K 2317/64* (2013.01); *C07K 2319/00* (2013.01)

(58) Field of Classification Search
CPC .............. C07K 16/468; C07K 16/2818; C07K 16/2878; C07K 2317/56; C07K 2317/624; C07K 2317/626; C07K 2317/64; C07K 2319/00; C07K 2317/51; C07K 2317/622
See application file for complete search history.

(56) References Cited

U.S. PATENT DOCUMENTS 5,196,193 A * 3/1993 Carroll ...................... 424/172.1
2007/0071675 A1* 3/2007 Wu et al. ..................... 424/1.49

FOREIGN PATENT DOCUMENTS

| JP | 2003-531588 A | | 10/2003 |
| WO | 95/09917 A1 | | 4/1995 |
| WO | 01/77342 A1 | | 10/2001 |
| WO | WO2005087810 | * | 9/2005 |
| WO | 2007/024715 A2 | | 3/2007 |
| WO | WO2007085814 | * | 8/2007 |

OTHER PUBLICATIONS

Wu et al, Nature Biotechnology 25(11): 1290-1297, Nov. 2007.*
Marvin et al, Acta Pharmacologica Sinica 26(6): 649-658, Jun. 2005.*
Yu et al, Investigative Ophthalmology & Visual Science 49(2): 522-527, Feb. 2008.*
Wu et al., J Mol Biol 294: 151-162, 1999.*
Colman et al., Research in Immunology (145(1):33-35, 1994.*
Dufner et al, Trends Biotechnol 24(11): 523-529, 2006.*
Wu et al., Nature Biotechnology 25(11): 1290-11297, Nov. 2007.*
Morrison et al., Nature Biotechnology 25(11): 1233-1234, 2007.*
MacCallum et al., J. Mol. Biol. 262 (5): 732-745, Oct. 11, 1996.*
Holm et al., Mol. Immunol. 44 (6): 1075-1084, Feb. 2007.*
European Patent Office, Search Report, dated Oct. 7, 2015, issued in counterpart European Patent Application No. 09734826.2.
Partial Supplementary Search Report, dated May 22, 2015, issued by the European Patent Office in counterpart European Patent Application No. 09734826.2.
Juqun Shen et al.; "Single variable domain antibody as a versatile building block for the construction of IgG-like bispecific antibodies"; Journal of Immunological Methods; Elsevier; vol. 318; No. 1-2; Jan. 10, 2007; pp. 65-74.
A. Margaret Merchant et al.; "An efficient route to human bispecific IgG"; Nature Biotechnology; Nature Publishing Group; vol. 16; No. 7; Jul. 1, 1998; 6 pages total.

* cited by examiner

*Primary Examiner* — Phuong Huynh
(74) *Attorney, Agent, or Firm* — Sughrue Mion, PLLC

(57) ABSTRACT

The present invention relates to a multivalent antibody comprising multiple heavy chain variable regions of antibody linked to each other via a linker comprising an amino acid sequence encoding an immunoglobulin domain or a fragment thereof.

5 Claims, 1 Drawing Sheet

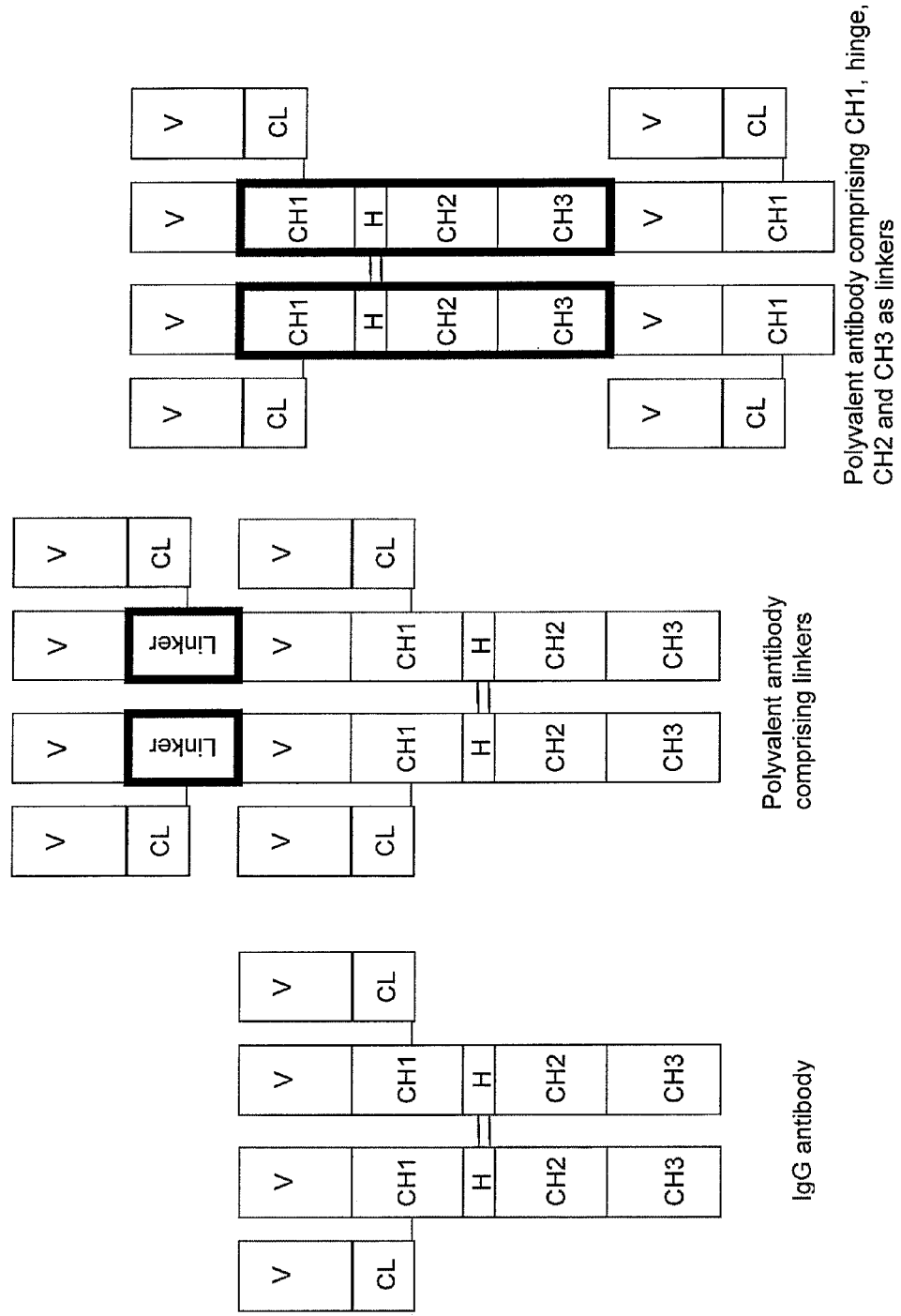

STABLE MULTIVALENT ANTIBODY

TECHNICAL FIELD

The present invention relates to a multivalent antibody in which multiple heavy chain variable regions of antibody (hereinafter, simply referred to as VH) are linked to each other via an immunoglobulin domain or a fragment thereof; DNA encoding an amino acid sequence of the multivalent antibody; a vector comprising the DNA; a transformant which expresses the multivalent antibody; and a method for producing the multivalent antibody using the transformant.

BACKGROUND ART

Immunoglobulins are glycoproteins which exist in serum, and tissue and body fluid of all mammals and have a function of recognizing foreign antigens (Non-patent Literature 1). The antibody is involved in biological defense through activation of the complement system and activation of their effector functions, such as effects of cell phagocytosis, antibody-dependent cellular cytotoxicity, mediator release, antigen presentation, via receptors (FcR) existing on the cell surface. There are five different classes of human immunoglobulins, namely IgG, IgA, IgM, IgD, and IgE. IgG can be classified into the 4 subclasses of IgG1, IgG2, IgG3, and IgG4. Also, IgA can be classified into 2 subclasses of IgA1 and IgA2. The basic structure of immunoglobulin is composed of two L (light) chains and two H (heavy) chains. Class and subclass of the immunoglobulin are determined by H chains. Different class and subclass of immunoglobulins are known to have different functions. For instance, the level of complement-binding ability decreases in the following order: IgM>IgG3>IgG1>IgG2. Also, the level of affinity to FcγRI (Fc receptor I) decreases in the following order: IgG3>IgG1>IgG4>IgG2. In addition, IgG1, IgG2, and IgG4 can bind to protein A. Specificity of antibody to an antigen is determined by the combination of heavy chains and light chains. In the case of IgG, one molecule is composed of two pair of a heavy chain and a light chain and has two antibody recognition sites per one antibody molecule.

In recent years, many clinical trials for monoclonal antibodies have been carried out. In addition, there are many monoclonal antibodies which are commercially available (Non-Patent Literature 2). In 1986, a mouse anti-CD3 antibody, muromonab-CD3, was approved by the FDA. In 1994, a chimeric antibody abciximab in which a mouse constant region of the antibody was substituted with a human constant region in order to reduce the antigenicity was approved. Humanization technologies were developed in order to further reduce the antigenicity. In 1997, an anti-CD20 humanized antibody, daclizumab, in which a variable region was humanized was approved. In 2002, the fully human anti-TNFα antibody, adalimumab, was approved.

For the purpose of modifying the antibody activity, production of mutants of various antibodies has been attempted. For example, a multivalent antibody which recognizes different antigens was produced by a hybrid hybridoma. However, when this method is used, since two different types of heavy chain and light chain are expressed in one cell, approximately ten combinations of the heavy chain and the light chain of an antibody are obtained. Accordingly, as a result, the productivity of a multivalent antibody having desired combination of a heavy chain and a light chain is lowered, and moreover it is difficult to isolate and purify the targeted multivalent antibody (Non-Patent Literature 3).

In order to overcome this problem, an attempt to produce an antibody having a correct combination of polypeptides by reducing the variations of the combinations of subunits by linking multiple antigen recognition sites in one polypeptide chain has been reported. For example, an antibody comprising scFv in which antigen recognition sites of a heavy chain and a light chain are linked to each other via one polypeptide (Non-Patent Literature 4) is known. Moreover, an antibody in which two antigen recognition sites are linked each other using an CH1 domain of a H chain constant region, a partial fragment of thereof, or L chain constant region of an antibody IgG1, or a flexible linker (Gly-Gly-Gly-Gly-Ser; SEQ ID NO: 376) (Non-Patent Literature 5, Patent Literature 1, Patent Literature 2) or the like has been reported.

However, such a conventional multivalent antibody has disadvantages in that antibody protein is easily aggregated, and stability and productivity thereof are low.

CITATION LIST

Non-Patent Literature

Non-patent Literature 1: Charles A. Janeway et al. *Immunobiology*, 1997, Current Biology Ltd/Garland Publishing Inc.

Non-patent Literature 2: Emmanuelle Laffy et al., *Human Antibodies* 14, 33-55, 2005

Non-patent Literature 3: Suresh et al., *Methods Enzymol.* 121, 210-228, 1986

Non-patent Literature 4: Gruber et al., *J. Immunol.* 152, 5369, 1994

Non-patent Literature 5: Wu et al., *Nat. Biotech.* 25, 1290-1297, 2007

Non-patent Literature 6: Kabat et al., *Sequences of proteins of immunological interest*, 1991 Fifth edition Non-patent Literature 7: Tomizuka. et al., *Proc Natl Acad Sci USA.*, 2000 Vol 97:722

Non-patent Literature 8: Yelton, D. E. et al. *Current Topics in Microbiology and Immunology*, 81, 1-7 (1978)

Non-patent Literature 9: Kohler, G et al. *European J. Immunology*, 6, 511-519 (1976)

Non-patent Literature 10: Shulman, M. et al. *Nature*, 276, 269-270 (1978)

Non-patent Literature 11: Kearney, J. F. et al. *J. Immunology*, 123, 1548-1550 (1979)

Non-patent Literature 12: Horibata, K. and Harris, A. W. *Nature*, 256, 495-497 (1975)

Non-patent Literature 13: P. J. Delves. *ANTIBODY PRODUCTION ESSENTIAL TECHNIQUES.*, 1997 WILEY Non-patent Literature 14: P. Shepherd and C. Dean. *Monoclonal Antibodies.*, 2000 OXFORD UNIVERSITY PRESS, Non-patent Literature 15: J. W. Goding. *Monoclonal Antibodies: principles and practice.*, 1993, ACADEMIC PRESS

Patent Literature

Patent Literature 1: US2007/0071675

Patent Literature 2: WO2001/77342

SUMMARY OF INVENTION

Technical Problem

A multivalent antibody which has multiple antigen recognition sites and is highly stable and productive has been required for long time.

Solution to Problem

As a result of deliberation to solve the above-mentioned problem, the present inventors have found that, among multivalent antibodies comprising multiple antigen recognition sites in one heavy chain polypeptide, a multivalent antibody comprising antigen recognition sites which are not close to each other is highly stable and excellent in productivity.

The present inventors have found that such a multivalent antibody is highly stable and productive and therefore is useful for various drugs and reagents for studies, and have accomplished the present invention based on this knowledge.

That is, the present invention is summarized to comprise the following characteristics.

(1) A multivalent antibody, comprising multiple heavy chain variable regions of antibody (hereinafter, referred to as VH) linked to each other via a linker comprising an amino acid sequence encoding an immunoglobulin domain or a fragment thereof.

(2) The multivalent antibody described in (1), wherein the immunoglobulin domain is an immunoglobulin domain comprising CH1, hinge, CH2, and/or CH3.

(3) The multivalent antibody described in (2), wherein the immunoglobulin domain is CH1 or a CH1 fragment.

(4) The multivalent antibody described in (3), wherein the CH1 fragment is a CH1 fragment comprising 14 amino acids with cysteine (Cys) at position 14.

(5) The multivalent antibody described in (4), wherein the CH1 fragment is an amino acid sequence positions at 1 to 14 from the N-terminal of an amino acid sequence of CH1 of an antibody subclass selected from IgD, IgM, IgG, IgA, and IgE.

(6) The multivalent antibody described in (5), wherein the amino acid sequence of the CH1 fragment is the amino acid sequences represented by any one selected from SEQ ID NO:311 and SEQ ID NOs:334 to 361.

(7) The multivalent antibody described in (3), wherein the amino acid sequence of the CH1 fragment is the amino acid sequences represented by any one selected from SEQ ID NOs:362 to 375.

(8) The multivalent antibody described in any one of (1) to (7), comprising the same light chains.

(9) A DNA encoding an amino acid sequence encoding the multivalent antibody described in any one of (1) to (8).

(10) A recombination vector comprising the DNA described in (9).

(11) A transformant into which the recombination vector described in (10) is introduced.

(12) A method for producing the multivalent antibody described in any one of (1) to (8), comprising culturing the transformant described in (11) in medium to produce and accumulate the multivalent antibody described in any one of (1) to (8) in the culture, and recovering the antibody or the fragment of the antibody from the culture.

Advantageous Effects of Invention

The multivalent antibody of the present invention is highly stable and excellent in productivity. In addition, the multivalent antibody of the present invention can be used as a therapeutic agent or a diagnostic agent for various types of disease. Moreover, the multivalent antibody of the present invention can be used as a stable reagent for research.

This description includes part or all of the contents as disclosed in the description of Japanese Patent Application No. 2008-115463, which is a priority document of the present application.

BRIEF DESCRIPTION OF DRAWINGS

FIG. 1 is a diagram illustrating a structure of a multivalent antibody of the present invention. The heavy-line frames represent linker structures.

DESCRIPTION OF EMBODIMENTS

The terms used in the present invention includes the following definitions.

The term "antibody" of the invention represents antibodies derived from genes (generally referred to as antibody genes) encoding the entire or a partial of a heavy chain variable region, a heavy chain constant region, a light chain variable region, and a light chain constant region, which together constitute an immunoglobulin. The antibody of the present invention includes an antibody of any immunoglobulin class and subclass.

The "human antibody" means an antibody comprising a sequence encoding a human-derived antibody gene and can be obtained from a technology, such as Phage Display, Yeast Display, or the like using a human B-cell hybridoma, a humanized SCID mouse, a mouse expressing a human antibody gene or a human antibody gene library. The "humanized antibody" represents an antibody in which parts of the antibody sequence obtained from animals other than humans are grafted with a human antibody sequence (Emmanuelle Laffy et al., *Human Antibodies* 14, 33-55, 2005).

The "heavy chain" represents a polypeptide having a higher molecular weight of two kinds of polypeptides (H chain and L chain) which constitute an immunoglobulin molecule. The heavy chain determines a class and a subclass of an antibody. Each of IgG1, IgG2, IgG4, IgA1, IgA2, IgM, IgD and IgE, has a different constant region of the heavy chain in the amino acid sequence.

The "light chain" represents a polypeptide having a lower molecular weight of two kinds of polypeptides (H chain and L chain) which constitute an immunoglobulin molecule. In the case of human antibodies, there are two kinds of light chains, referred to as κ and λ.

The "variable region" (also referred to as a V region) represents a highly-diverse region in an amino acid sequence which generally exists at an N-terminal side of immunoglobulin. The other part of the immunoglobulin has a structure with a poor diversity, and thereby is referred to as a "constant region" (also referred to as a C region). The variable regions of a heavy chain and a light chain form a complex and the complex determines the property of an antibody against an antigen. As for a heavy chain of a human antibody, the amino acid sequence at position 1 to 117 of the EU index by Kabat et al. (Kabat et al., *Sequences of proteins of immunological interest* 1991 Fifth edition) corresponds to the variable region, and the constant region starts from the amino acid at position 118. As for a light chain of a human antibody, the amino acid sequence at position 1 to 107 of the EU index by Kabat et al. corresponds to the variable region, and the constant region starts from the amino acid at position 108. In the following description, a heavy chain variable region or a light chain variable region is simply referred to as VH or VL, respectively.

The "antigen recognition site" is a site which recognizes an antigen and forms a three-dimensional structure complementary to an antigen determinant (epitope). The antigen recognition site can induce a strong molecular interaction with an antigen determinant. Examples of the antigen recognition site include a heavy chain variable region (VH) and a light chain variable region (VL) which comprise at least three complementary determining regions (simply referred to as CDR). In a human antibody, each of the heavy chain variable region and the light chain variable region has three complementary determining regions (CDRs) and antigen recognition sites. These CDRs are referred to as CDR1, CDR2, and CDR3, respectively in the order of position from the N-terminal side.

The "multivalent antibody" represents an antibody comprising at least two or more antigen recognition sites in a heavy chain and/or a light chain. Each of the antigen recognition sites may recognize the same antigen determinant or may recognize different antigen determinants.

The multivalent antibody of the present invention is a multivalent antibody in which multiple heavy chain variable regions of antibody are linked to each other via an immunoglobulin domain or a fragment thereof.

The multivalent antibody of the present invention is specifically characterized in that (a) multiple (such as 2 to 5) different antigen recognition sites are comprised in one heavy chain polypeptide, and the antigen recognition sites are separated and are not close to each other, (b) the antigen recognition sites are linked in tandem via a polypeptide linker comprising 10 amino acids or more, preferably 50 amino acids or more, and more preferably 50 to 500 amino acids, specifically, for example, the antigen recognition sites are linked by a linker having the entire or a partial of an amino acid sequence of an immunoglobulin domain, (c) the antigen recognition site in a light chain forms a complex with the corresponding antigen recognition site in a heavy chain, (d) the multivalent antibody has an antibody structure comprising two heavy chain polypeptides and at least four light chain polypeptides as shown in FIG. 1, a disulfide bond which links the two heavy chain polypeptides in these hinge region, and a disulfide bond which links the light chain polypeptide with the heavy chain polypeptide, (e) the constant region of the heavy chain comprises the entire or a partial of the constant region of a native antibody heavy chain (such as a CH1 fragment, CH1, CH2, CH3, CH1-hinge, CH1-hinge-CH2, CH1-hinge-CH2-CH3, or the like) and the like.

More specifically, FIG. 1 illustrates both a linker structure and an example of the structure of a multivalent antibody.

The "immunoglobulin domain" represents a peptide comprising an amino acid sequence similar to that of immunoglobulin and comprising approximately 100 amino acid residues including at least two cysteine residues. Examples of the immunoglobulin domain include VH, CH1, CH2, and CH3 of an immunoglobulin heavy chain, and VL and CL of an immunoglobulin light chain. In addition, the immunoglobulin domain is found in proteins other than immunoglobulin. Examples of the immunoglobulin domain in proteins other than immunoglobulin include an immunoglobulin domain included in a protein belonging to an immunoglobulin super family, such as a major histocompatibility complex (MHC), CD1, B7, T-cell receptor (TCR), and the like. Any of the immunoglobulin domains can be used as an immunoglobulin domain for the multivalent antibody of the present invention.

An antibody which recognizes a single antigen is defined as a monoclonal antibody.

The monoclonal antibody is an antibody which is secreted by an antibody-producing cell of a single clone, recognizes only one epitope (also referred to as an antigen determinant), and has a uniform amino acid sequence (primary structure) constituting the monoclonal antibody.

Examples of the epitope include a single amino acid sequence, a three-dimensional structure comprising the amino acid sequence, a sugar chain-bound amino acid sequence, a three-dimensional structure comprising a sugar chain-bound amino acid sequence, and the like, recognized and bound by a monoclonal antibody.

A highly flexible amino acid region called a "hinge region" exists between CH1 and CH2.

In a human antibody, CH1 means a region having the amino acid sequence at positions 118 to 215 of the EU index. Similarly, the hinge region represents a region having the amino acid sequence at positions 216 to 230 of the EU index, CH2 represents a region having the amino acid sequence at positions 231 to 340 of the EU index, and CH3 represents a region having the amino acid sequence at positions 341 to 446 of the EU index.

"CL" represents a constant region of a light chain. In the case of a κ chain of a human antibody, CL represents a region having the amino acid sequence at positions 108 to 214 of the EU index by Kabat et al. In a λ chain, CL represents a region having the amino acid sequence at positions 108 to 215.

The "linker" represents a chemical structure which links two antigen recognition sites. The linker is preferably a polypeptide.

Preferable examples of the linker used for the multivalent antibody of the present invention include a linker having the entire or a partial of the amino acid sequence of the immunoglobulin domain, a linker having the entire or a partial of the amino acid sequence of a linker comprising multiple immunoglobulin domains.

The amino acid sequence selected from the immunoglobulin domain may be intermittent or continuous, but is preferably the continuous amino acid sequence. In the present invention, examples of preferable linker include a polypeptide comprising 10 or more amino acids, preferably 14 or more amino acids, more preferably 50 or more amino acids, such as comprising 50 or more amino acids to 500 or less amino acids.

In the present invention, it is possible to appropriately combine the entire or a partial of fragments of an amino acid sequence of CH1, hinge, CH2, and CH3 of an antibody to use as a linker. In addition, an amino acid sequence in which the above amino acid sequence is partially deleted or in which the order of amino acid is changed also can be used.

Examples of the immunoglobulin domain and the fragment thereof used for the multivalent antibody of the present invention include an immunoglobulin domain comprising CH1-hinge-CH2-CH3 (in the order from N-terminal to C-terminal), an immunoglobulin domain comprising CH1-hinge-CH2, an immunoglobulin domain comprising CH1-hinge, an immunoglobulin domain comprising CH1, a fragment comprising the N-terminal side of CH1, CH1 fragment comprising 14 amino acid residue in which the amino acid at position 14 of CH1 is Cys, CH1 fragment comprising 14 amino acid residue from the N-terminal side of CH1 and the one in which one or more amino acid residues in the amino acid sequence of these immunoglobulin domain fragments are substituted, though it is not particularly limited.

The immunoglobulin domain and the fragment thereof may be derived from any one of the subclasses selected from the immunoglobulin subclasses IgD, IgM, IgG1, IgG2, IgG3, IgG4, IgA1, IgA1 and IgE, and preferably derived from IgG or IgM.

In the present invention, specific examples of the immunoglobulin domain and the fragment thereof include an immunoglobulin domain comprising CH1, hinge, CH2, and CH3 and represented by SEQ ID NO:99, an immunoglobulin domain comprising CH1, hinge, and CH2 and represented by the amino acid sequence at positions 1 to 219 of SEQ ID NO:99, an immunoglobulin domain comprising CH1 and hinge and represented by the amino acid sequence at positions 1 to 94 of SEQ ID NO:99, and an immunoglobulin domain comprising CH1 and represented by SEQ ID NO:77.

In addition, in the present invention, examples of the CH1 fragment include the CH1 fragment represented by any one of SEQ ID NOs:362 to 375, the CH1 fragment comprising 14 amino acid residues in which the amino acid at position 14 of CH1 is Cys and the CH1 fragment comprising 14 amino acid residues of the N-terminal side of CH1, and more specifically, the CH1 fragment represented by any one of SEQ ID NO:311 and SEQ ID NOs:334 to 361.

Examples of the multivalent antibody of the present invention include a multivalent antibody comprising two or more heavy chain variable regions linked via the above-mentioned immunoglobulin domain or the fragment thereof. When three or more heavy chain variable regions are linked to each other, different immunoglobulin domains or the fragments thereof may be used, or the same immunoglobulin domains and the fragments thereof may also be used. In addition, when two or more heavy chain variable regions are linked to each other, it is possible to change the length or the kind of the immunoglobulin domain or the fragment thereof such that each VH can bind to a specific antigen.

In the present invention, the light chain variable regions included in the multivalent antibody may be the same light chain variable regions or different light chain variable regions. The heavy chain variable region of the multivalent antibody which can bind to two or more antigens and the same light chain variable regions can be appropriately selected by using a method such as Phage Display such that each antibody variable region can bind to a specific antigen.

The antigen to which the multivalent antibody of the present invention binds is not particularly limited. Examples of the antigen include an antigen which is associated with a disease relating to an abnormal cell growth, such as a cancer, an autoimmune disease, an allergy disease, and the like, and an antigen involved in organ regeneration and tissue regeneration; and the multivalent antibody of the present invention can be bound to those two or more different antigens or epitopes. That is, the multivalent antibody of the present invention can be bound to two different antigens or two different epitopes existing in one antigen. In addition, since the multivalent antibody of the present invention can activate or inactivate the antigen after binding thereto, it is possible to select the antigen suitable for a target disease. Hereinafter, antigens which may be a target of the multivalent antibody of the present invention will be exemplified. However, the antigens are not limited thereto.

The antigen in which apoptosis is induced by binding of the antibody includes cluster of differentiation (hereinafter "CD") 19, CD20, CD21, CD22, CD23, CD24, CD37, CD53, CD72, CD73, CD74, CDw75, CDw76, CD77, CDw78, CD79a, CD79b, CD80 (B7.1), CD81, CD82, CD83, CDw84, CD85, CD86 (B7.2), human leukocyte antigen (HLA)-Class II, epidermal growth factor receptor (EGFR) and the like.

The antigen participating in formation of pathologic state of tumor or the antigen for the antibody which regulates immunological function includes CD40, CD40 ligand, B7 family molecule (CD80, CD86, CD274, B7-DC, B7-H2, B7-H3, B7-H4), ligand of B7 family molecule (CD28, CTLA-4, ICOS, PD-1, BTLA), OX-40, OX-40 ligand, CD137, tumor necrosis factor (TNF) receptor family molecule (DR4, DR5, TNFR1, TNFR2), TNF-related apoptosis-inducing ligand receptor (TRAIL) family molecule, receptor family of TRAIL family molecule (TRAIL-R1, TRAIL-R2, TRAIL-R3, TRAIL-R4), receptor activator of nuclear factor kappa B ligand (RANK), RANK ligand, CD25, folic acid receptor 4, cytokine [IL-1α, IL-1β, IL-4, IL-5, IL-6, IL-10, IL-13, transforming growth factor (TGF) β, TNFα, etc.], receptors of these cytokines, chemokine (SLC, ELC, I-309, TARC, MDC, CTACK, etc.), receptors of these chemokines, vascular endothelial growth factor (VEGF), Angiopoietin, fibroblast growth factor (FGF), EGF, platelet-derived growth factor (PDGF), insulin-like growth factor (IGF), hepatocyte growth factor (HGF), erythropoietin (EPO), TGFβ, IL-8, Ephilin, SDF-1 and receptors of them.

The antigen involved in angiogenesis in the pathologic part and organ or tissue regeneration includes vascular endothelial growth factor (VEGF), angiopoietin, fibroblast growth factor (FGF), EGF, platelet-derived growth factor (PDGF), insulin-like growth factor (IGF), erythropoietin (EPO), TGFβ, IL-8, Ephilin, SDF-1, receptors thereof and the like.

In the present invention, the effector activation of the multivalent antibody can be controlled as follows.

An effector activity of a monoclonal antibody obtained by the method of the present invention can be controlled by various methods. For example, known methods are a method for controlling an amount of fucose (hereinafter, referred to also as "core fucose") which is bound N-acetylglucosamine (GlcNAc) through α-1,6 bond in a reducing end of a complex type N-linked sugar chain which is bound to asparagine (Asn) at position 297 of an Fc region of an antibody (WO2005/035586, WO2002/31140, and WO00/61739), a method for controlling an effector activity of a monoclonal antibody by modifying amino acid group(s) of an Fc region (constant region comprising CH2 and CH3 domains) of the antibody, and the like. The effector activity of the multivalent antibody of the present invention can be controlled by using any of the methods.

The "effector activity" means an antibody-dependent activity which is induced via an Fc region of an antibody. As the effector activity, an antibody-dependent cellular cytotoxicity (ADCC activity), a complement-dependent cytotoxicity (CDC activity), an antibody-dependent phagocytosis (ADP activity) by phagocytic cells such as macrophages or dendritic cells, and the like are known.

In addition, by controlling a content of core fucose of a complex type N-linked sugar chain of Fc of an antibody, an effector activity of the multivalent antibody can be increased or decreased. As a method for lowering a content of fucose which is bound to a complex type N-linked sugar chain bound to Fc of the antibody, an antibody to which fucose is not bound can be obtained by the expression of an antibody using a CHO cell which is deficient in a gene encoding α-1,6-fucosyltransferase. The antibody to which fucose is not bound has a high ADCC activity. On the other hand, as a method for increasing a content of fucose which is bound to a complex type N-linked sugar chain bound to Fc of the multivalent antibody, a multivalent antibody to which fucose is bound can be obtained by the expression of an antibody using a host cell into which introduce a gene encoding α-1,6-fucosyltransferase. The antibody to which fucose is bound has lower ADCC activity than an antibody to which fucose is not bound.

Further, by modifying amino acid residue(s) in an Fc region of a multivalent antibody, the ADCC activity or CDC activity can be increased or decreased. For example, the CDC activity to a multivalent antibody can be increased by using the amino acid sequence of the Fc region described in US2007/0148165. Further, the ADCC activity or CDC activity can be increased or decreased by modifying the amino acid as described in U.S. Pat. No. 6,737,056, 7,297,775 or 7,317,091.

Moreover, it is possible to obtain a multivalent antibody, in which the effector activation of the multivalent antibody is controlled by applying the above-mentioned methods in combination to one multivalent antibody.

In a DNA sequence encoding the multivalent antibody of the present invention, it becomes more easily to change the sequence of the heavy chain variable region and the linker variously by introducing a restriction enzyme site between the heavy chain variable region and the linker.

The stability of the multivalent antibody of the present invention can be evaluated by measuring an amount of aggregate (oligomer) formed in the sample which is in the purification process or preserved under a constant condition. That is, when the aggregate amount is decreased under the same condition, it is determined that the stability of the antibody is improved. The aggregate amount can be measured by separating aggregated antibody from antibody that has not been aggregated, using an appropriate chromatography method including gel-filtration chromatography. The method of measuring the aggregate amount will be exemplified in Example 18.

The productivity of the multivalent antibody of the present invention can be evaluated by measuring an amount of the antibody in culture medium produced from an antibody-producing cell. More specifically, the productivity can be evaluated by measuring the amount of the antibody contained in culture supernatant which has been obtained by removing producing cells from the culture medium using an appropriate method, such as an HPLC method, and an ELISA method. The method of measuring the productivity will be exemplified in Example 17.

In regard to the antibody of the present invention, it is possible to determine the animal of origin to be used for the variable region and the constant region of the heavy chain and the light chain depending on the target animals to be used and purposes of the use. For example, when a target animal is a human, it is possible to select human origin or mouse origin for a variable region, human origin for the constant region, and human origin for a linker.

In this specification, "animals" generally represents mammals including human, monkey, chimpanzee, mouse, rat, cattle, pig, goat, sheep, camel, bird, and the like.

Although specific examples of the antibody of the present invention will be described in the following Examples, the antibody of the present invention also includes derivatives of the antibody. The derivative includes substitution, deletion, addition, and/or insertion of 1 to about 30 amino acids, preferably of 1 to several amino acids, (such as, 1 to 10, preferably 1 to 5, more preferably 1 to 3 amino acids) in the amino acid sequence of the antibody of the present invention. Examples of the amino acid substitution include a conservative amino acid substitution, and this substitution means a substitution between amino acids which have similar electric charges, polarities (or hydrophobic properties), or side chains with similar structures. Examples of the above amino acid group include basic amino acids (Lys, Arg, His), acidic amino acids (Asp, Glu), polar amino acids with no charge (Gly, Asn, Gln, Ser, Thr, Tyr, Cys), nonpolar amino acids (Ala, Val, Leu, Ile, Pro), aromatic amino acids (Phe, Trp, Tyr, His), and the like.

Moreover, the antibody of the present invention may be chemically modified. Examples of the modification includes pegylation, acetylation, amidation, phosphorylation, glucosylation, and the modification can generally be performed via a functional group such as an amino group, a carboxyl group, a hydroxyl group, or the like. Alternatively, the antibody of the present invention may be conjugated with a medical or diagnostic material. The medical or diagnostic material is not particularly limited. Examples include a peptide, a polypeptide, a nucleic acid, a small molecule, an inorganic element, an inorganic molecule, an organic molecule, and the like. The medical material is a material which can exhibit a therapeutic efficacy for a target site in a body. Examples include an anticancer agent, an anti-virus agent, and the like. Examples of the diagnostic material include a radioisotope. A covalent bonding, non-covalent bonding, biotin/avidin (or streptavidin) system, and the like can be used for the conjugation. Alternatively, the antibody of the present invention may be fixed to a solid phase (for example, resin, plastic, paper, metal) such as a plate, a bead, a test strip and an array.

Hereinafter, a detailed description will be made of a method for producing the multivalent antibody. However, the method for producing the antibody is not limited thereto.

(1) Method for Producing Monoclonal Antibody

In the present invention, the following preparation steps are included in the process for producing the antibody.

Namely, (1) purifying antigen to be used as immunogen and/or producing a cell which excessively expresses antigen on the cell surface, (2) immunizing an animal with the antigen, followed by collecting the blood to test the antibody titer, determining the timing for enucleation of such as spleen, and preparing an antibody-producing cell, (3) preparing a myeloma cell (hereinafter, referred to as a "myeloma"), (4) producing a hybridoma using the cell fusion between the antibody-producing cell and the myeloma, (5) selecting hybridoma groups which produce target antibodies, (6) separating into single-cell clones (cloning), and the like.

Hereinafter, the method for producing the monoclonal antibody is described in detail in line with the above-mentioned steps. However, the method for producing the antibody is not limited thereto, and it is also possible to use an antibody-producing cell other than splenic cells and a myeloma. In addition, it is also possible to use an antibody derived from animal serum.

(1-1) Purification of Antigen

An antigen protein may be used as it is, or antigen protein may be used in a form of a fusion protein by fusing with another appropriate polypeptide. Examples of the fusion protein include a fusion protein of an extracellular region of antigen protein with an Fc region of human IgG or a glutathioneS-transferase (GST). The above fusion protein can be obtained by preparing an expression vector for animal cells comprising a nucleotide sequence encoding the fusion protein of an extracellular region of antigen with a constant region of human IgG or a GST, introducing the expression vector into the animal cells, and purifying the from the culture supernatant of the obtained transformant. In addition, purified antigen itself which expresses on a cellular membrane of a human cell line is also used as an antigen.

(1-2) Preparation Step of Antibody-Producing Cell

The antigen obtained in (1-1) is mixed with complete or incomplete Freund's adjuvant or an additive agent such as aluminum potassium sulfate and immunized with an experimental animal as an immunogen. As the experimental animal, for example, a mouse can be used. A transgenic mouse having an ability to produce an antibody of human origin is most preferably used, and such a mouse is described in a literature by Tomizuka et al. (Tomizuka. et al., *Proc Natl Acad Sci USA.*, 2000 Vol 97:722).

The administration method of the immunogen at the time of mouse immunization may be any one selected from hypodermic injection, intraperitoneal injection, intravenous injection, intradermal injection, intramuscular injection, footpad injection, and the like. Among them, intraperitoneal injection, footpad injection, or intravenous injection is preferably used.

The immunization may be performed once or performed repeatedly at an appropriate interval (preferably at an interval from three days to one week). Thereafter, the antibody titer against the antigen in the serum of the immunized animal is measured. If an animal of which the antigen titer has been sufficiently increased is used as a supply source of the antibody-producing cell, it is possible to enhance the efficiency of the following operations. Generally, an antibody-producing cell derived from an animal after three to five days from the last immunization is preferably used for the following cell fusion.

As a method of measuring the antibody titer used here, various known techniques such as a radioimmunoassay method (hereinafter referred to as an "RIA method"), an enzyme linked immunosorbent assay method (hereinafter referred to as an "ELISA method"), a fluorescence antibody method, and a passive hemagglutination method can be used.

When the ELISA method is used, the antibody titer in the present invention can be measured by the following steps. First, purified or partially purified antigen is put into a solid phase surface of such as a 96-well plate for ELISA to absorb, the surface of the solid phase to which the antigen is not absorbed is covered with protein having no relation with the antigen, such as bovine serum albumin (hereinafter, referred to as a "BSA"), the surface is washed and then allowed to contact with a sample (for example, a mouse serum) as a primary antibody which has been serially diluted, and then the antibody in the sample is bound to the antigen. Furthermore, the antibody titer is calculated by adding an enzyme-labeled antibody against human antibody as a secondary antibody to be bound to the human antibody. After washing the resulting object, a substrate of the enzyme is added to measure the variation of the absorbance due to the chromogen caused by the substrate degradation.

(1-3) Preparation of Myeloma Cell

As a myeloma, a cell which is derived from a mouse, a rat, a guinea pig, a hamster, a rabbit, a human or the like and does not have an ability of producing autoantibody can be used. Generally, as myeloma cells, a cell line obtained from mouse can be used. Examples include 8-azaguanine-resistant mouse (derived from BALB/c mouse) myeloma cell line P3X63Ag8U.1 (P3-U1) [Yelton D. E. et al., *Current Topics in Microbiology and Immunology*, 81, 1-7 (1978)], P3/NS1/1-Ag4-(NS-1) [Kohler G et al., *European J Immunology*, 6, 511-519 (1976)], Sp2/0-Ag14 (SP-2) [Shulman M. et al., *Nature*, 276, 269-270 (1978)], P3X63Ag8.653 (653) [Kearney J. F. et al., *Immunology*, 123, 1548-1550 (1979)], P3X63Ag8 (X63) [Horibata K. and Harris A. W. et al., *Nature*, 256, 495-497 (1975)] and the like. These cell lines are subcultured in an appropriate medium, such as an 8-azaguanine medium [a medium in which 8-azaguanine is added to RPMI-1640 medium containing glutamine, 2-mercaptoethanol, gentamicin and fetal calf serum (hereinafter referred to as FCS)], Iscove's Modified Dulbecco's Medium (hereinafter referred to as IMDM) and Dulbecco's Modified Eagle Medium (hereinafter referred to as DMEM), and they are subcultured in the normal medium (for example, DMEM including 10% FCS) 3 or 4 days before cell fusion to ensure the cell number of $2 \times 10^7$ or more on the day for fusion.

(1-4) Cell Fusion

The antibody-producing cell is a plasma cell or a lymphocyte which is a precursor thereof and may be obtained from any parts of the individual. Generally, the antibody-producing cell can be obtained from spleen, lymph node, marrow, tonsils, peripheral blood, or a combination thereof. The splenic cell is most generally used.

After the last immunization, a part in which the antibody-producing cells exist, for example, spleen is excised from the experimental animal (for example, a mouse) in which a predetermined antibody titer has been attained, and splenic cells as antibody-producing cells are prepared. The most generally used method for fusing these splenic cells with the myeloma obtained in the step (3) is a method using polyethylene glycol since it causes relatively low cell cytotoxicity and operations for fusion are easy. For example, this method includes the following steps.

The splenic cells and the myeloma are sufficiently washed with serum-free culture medium (for example, DMEM) or phosphate buffered saline (hereinafter, referred to as "phosphate buffer") and mixed to give a ratio of the splenic cells: the myeloma cells=5:1 to 10:1, followed by centrifugation. After the supernatant is removed, the deposited cell group is sufficiently loosened. Then, serum-free culture medium containing 1 mL of 50% (w/v) polyethylene glycol (molecular weight: 1000 to 4000) is dropped thereto while stirring the resulting object. Thereafter, 10 mL of serum-free culture medium is slowly added, and then the resulting mixture is centrifuged. The supernatant is removed again, the deposited cells are suspended in an appropriate amount of normal culture medium (hereinafter, referred to as a "HAT culture medium") containing hypoxanthine aminopterin thymidine (hereinafter, referred to as "HAT") solution and human interleukin-2 (hereinafter, referred to as "IL-2") and dispensed into respective wells in a culture plate (hereinafter, referred to as a "plate") to culture at 37° C. under 5% carbon dioxide for approximately two weeks. The HAT culture medium is appropriately supplemented during the culture.

(1-5) Selection Hybridoma Group

When the above-mentioned myeloma cells are an 8-azaguanine-resistant line, namely, the myeloma cells are a hypoxanthine-guanine phosphoribosyltransferase (HGPRT) deficient cell line, the not fused myeloma cells and the fusion cells between the myeloma cells cannot exist in the HAT-containing culture medium. Accordingly, it is possible to select the hybridoma by continuing to culture within the HAT-containing culture medium.

The culture medium in which the hybridoma is grown in a colony-shape is changed from the HAT culture medium to a culture medium from which aminopterin is removed (hereinafter, referred to as an "HT culture medium"). Thereafter, a part of the culture supernatant is collected, and the antibody titer is measured by such as the ELISA method.

As described above, although the method of using the 8-azaguanine-resistant cell line is exemplified, other cell lines can be used depending on the selecting method of the hybridoma.

(2) Method for Producing Multivalent Antibody

In the present invention, the multivalent antibody can be prepared by, for example, cloning genes of multiple monoclonal antibodies against different epitopes which are expressed from the hybridoma obtained as described above, determining antigen recognition sites and designing a gene of the multivalent antibody containing the obtained antigen recognition sites. More specifically, the nucleotide sequence of the multivalent antibody comprising the obtained antigen recognition sites and linker are appropriately combined is synthesized and incorporated into an expression plasmid.

Here, the linker links an antigen recognition site and another antigen recognition site, is generally constituted by a polypeptide of 10 amino acids or more, preferably of 50 amino acids or more, and more preferably includes 50 amino acids to 500 amino acids. In the embodiment of the present invention, a more preferable linker is a linker consisting of CH1 of a human antibody heavy chain constant region or a linker comprising CH1 such as a linker constituted by CH1-hinge-CH2-CH3 as shown in FIG. 1. Specifically, the former linker has an amino acid sequence represented by SEQ ID NO:77, and the latter linker has an amino acid sequence represented by SEQ ID NO:99.

In addition, examples of the expression plasmid include pTracer-CMV/Bsd, pTracer-EF/Bsd, pTracer-SV40 (Invitrogen by Life Technologies Corporation), and the like.

The expression plasmid is introduced into an appropriate producing cell (for example, animal cells such as CHO cells), and the obtained transformant is cultured as multivalent antibody-producing cells. The multivalent antibody can be purified from the culture medium. Hereinafter, a detailed description will be made of a method for producing the multivalent antibody. However, the producing method of the multivalent antibody is not limited to the following description. Examples of a method for producing the multivalent antibody include a method in which the expression plasmid is expressed in an animal to express the multivalent antibody in serum or milk of the animal, a method in which the multivalent antibody is produced by chemically synthesizing a peptide, or the like.

(2-1) Cloning of Hybridoma

The hybridoma, which has been proved to prepare a specific antibody by measuring the antibody titer in the same manner as that described in (1-2), is moved to another plate to perform cloning. Examples of the cloning method include a limiting dilution method in which a hybridoma is diluted and cultured such that one hybridoma is contained in one well in the plate, a soft agar method in which a hybridoma is cultured in a soft agar culture medium to collect the colony, a method of picking up each one of the cells separately using a micro-manipulator to culture the cells, a "sorter clone" in which one cell is separated using a cell sorter, and the like. However, the limiting dilution method is a simple method and frequently used.

The cloning using such as the limiting dilution method is carried out to repeatedly 2 to 4 times to the well in which the antibody titer has been observed, and for the cell in which the antibody titer is continuously observed is selected as a monoclonal antibody-producing hybridoma.

(2-2) Producing Antibody-Producing Cell

A gene encoding a heavy chain and a light chain of an antibody is cloned from the antibody-producing cells such as the hybridoma which produces the antibody for each antigen. When a multivalent antibody is prepared using a single light chain, an antibody heavy chain optimized for the single light chain is selected by performing screening such as the phage display method so that the antibody variable region comprised in the multivalent antibody reacts with a specific antigen. A nucleotide sequence encoding the variable region of the selected heavy chain is linked with the linker sequence of the immunoglobulin domain or the fragment thereof used in the multivalent antibody of the present invention, and thereby the nucleotide sequence encoding the multivalent antibody heavy chain is prepared. The thus-prepared nucleotide sequence encoding the multivalent antibody heavy chain and a nucleotide sequence encoding the single light chain are inserted into an appropriate protein-expression vector to prepare a multivalent antibody expression vector. On the other hand, when multiple light chains which are different for each antigen are used, the nucleotide sequence encoding the multiple antibody heavy chain variable region is linked via the linker sequence for the immunoglobulin domain or the fragment thereof used for the multivalent antibody of the present invention to prepare the nucleotide sequence encoding the multivalent antibody heavy chain. The nucleotide sequences encoding the heavy chain and the light chain of the multivalent antibody may be inserted into a single expression vector as a tandem type multivalent antibody expression vector, or may be inserted into different expression vectors as a separate type of multivalent antibody expression vector. Then, the prepared multivalent antibody expression vector is introduced into a host (for example, mammal cells, *Escherichia coli*, yeast cells, insect cells, plant cells, or the like), and thereby a recombinant antibody prepared using a recombinant technology can be prepared (P. J. Deives. *ANTIBODY PRODUCTION ESSENTIAL TECHNIQUES.*, 1997 WILEY; P. Shepherd and C. Dean. *Monoclonal Antibodies.*, 2000 OXFORD UNIVERSITY PRESS; J. W. Goding, Monoclonal Antibodies: principles and practice. 1993 ACADEMIC PRESS).

Examples of the vector include phage, plasmid, a virus, an artificial chromosome, and the like, which can autonomously reproduce in the host. Examples of the plasmid DNA include plasmids derived from *Escherichia coli, Bacillus subtilis*, or yeast origin and the like. Examples of the phage DNA include λ phage, T7-phage, M13-phage and the like. Examples of the virus vector include adenovirus, adeno-associated virus, retrovirus, lentivirus and the like. Examples of the artificial chromosome include a mammal artificial chromosome (MAC) including a human artificial chromosome (HAC), a yeast artificial chromosome (YAC), a bacterial artificial chromosome (such as BAC, PAC) and the like.

The host to be used for the transformation is not particularly limited as long as it can express a targeted gene. Examples of the host include bacteria (*Escherichia coli, Bacillus subtilis*, or the like), yeast, animal cells (such as COS cells, CHO cells), insect cells and the like.

The method of introducing a gene into the host is known. An arbitrary method (such as a method using calcium ion, an electroporation method, a spheroplast method, a lithium acetate method, a calcium phosphate method, a lipofection method) can be used. In addition, examples of the method of introducing a gene to an animal include a method of introducing the gene into pluripotent cells such as embryonic stem (ES) cells, induced pluripotent stem (iPS) cells, or the like using a method such as a microcell method, a microinjection method, an electroporation method, and a lipofection method; and a nuclear transplantation method; and the like. In such a case, a transgenic animal can be produced by introducing pluripotent cells into a blastocyst and then implanting the obtained blastocyst to a uterus of a host.

Accordingly, the transformant containing the gene encoding the multivalent antibody of the present invention includes not only a cell but also an animal.

The multivalent antibody can be produced by synthesizing a gene encoding a multivalent antibody in which multiple antigen recognition sites and a linker are appropriately combined and incorporating the gene into an appropriate expression plasmid. The antigen recognition site can be obtained by specifying and separating the appropriate antigen recognition site using a technique such as a phage display method, a yeast display or the like as well as the above-mentioned method using the hybridoma (Emmanuelle Laffy et al., *Human Antibodies* 14, 33-55, 2005).

(2-3) Expressing and Purification of Multivalent Antibody

According to the present invention, the multivalent antibody can be obtained by culturing the transformant and collecting from the culture thereof. The "culture" means all of (a) the culture supernatant, (b) culture cells, culture bacterial bodies, or fragments thereof, and (c) the secretions of the transformant. When the transformant is cultured, a culture medium suitable for a host to be used is selected, and a stationary culture method, a culture method using a roller bottle, or the like is applied.

When the targeted protein is produced in a bacterial body or a cell after culturing, the antibody is collected by disrupting the bacterial body or the cell. When the targeted antibody is produced outside of the bacterial body or the cell, the culture solution is used as it is or used after removing the bacterial bodies or the cells by centrifugation or the like. Thereafter, the targeted antibody can be isolated and purified from the culture using single general biochemical method or an appropriate combination of general biochemical methods by means of various types of chromatography used for isolation and purification of proteins.

(3) Method of Determining Antigen Recognition Site

The identification of the recognition epitope of the monoclonal antibody can be carried out as follows. First, various partial structures of a molecule to be recognized by the monoclonal antibody are produced. In producing the partial structures, a method such as a method of producing various partial peptides of the molecule using a known oligopeptide synthesizing method, a method for producing the targeted partial peptide inside and outside of the host such as *Escherichia coli* by incorporating the nucleotide sequence encoding the targeted partial peptides into a suitable expression plasmid using a recombination technology can be used. However, both the methods are generally combined to use for the above purpose. For example, after preparing a series of polypeptides which are sequentially shortened to have an appropriate length from the C-terminal or the N-terminal of the antigen protein, using the recombination technology known by those skilled in the art, the reactivity of the monoclonal antibody against the series of polypeptides are examined to roughly determine the recognition site.

Thereafter, various oligopeptide, mutant thereof or the like in the corresponding part are further synthesized using an oligopeptide synthesizing technique known by those skilled in the art. Then the epitope can be confined by examining the binding property of the monoclonal antibody which is contained in a preventative agent or the therapeutic agent of the present invention as an effective ingredient against those peptides or by examining an competitive inhibitory activity of the peptide on the binding of the monoclonal antibody and the antigen. As a simple method for obtaining various oligopeptides, a commercially available kit (such as SPOTs kit (manufactured by Genosys Biotechnologies, Inc.), or a series of multipin peptide synthesis kit using a multipin synthesis method (manufactured by Chiron Corporation), or the like) can be used.

(4) Method of Antigen Binding Test

In the present invention, the test for binding of the antibody to the antigen can be carried out by using analysis by means of a flow cytometry using antigen expressing cells and a detection method utilizing a surface plasmon resonance using a soluble antigen as well as the ELISA method using the soluble antigen described in Example 19.

EXAMPLES

Hereinafter, the present invention will be described in detail with Examples of the multivalent antibody. However, it is needless to say that the present invention is not limited to these Examples.

In addition, antibodies of animals such as human and mouse and the sequences of the genes thereof can be used those registered in a gene bank such as GenBank.

Example 1

Preparation of First Antigen Recognition Site

In order to obtain a first antigen recognition site, anti-CD40 antibody disclosed in WO02/088186 was used. Specifically, a light chain and a heavy chain of the antibody (hereinafter, simply referred to as 341-1-19) produced by hybridoma KM341-1-19 (Accession No. BP-7759) was used. Hybridoma KM341-1-19 has been deposited with the National Institute of Advanced Industrial Science and Technology, International Patent Organism Depositary (AIST Tsukuba Central 6, 1-1-1 Higashi, Tsukuba, Ibaraki 305-8566 Japan).

Each of the full-length DNA sequence (SEQ ID NO:1) and the amino acid sequence (SEQ ID NO:2) of the 341-1-19 heavy chain, the DNA sequence (SEQ ID NO:3) and the amino acid sequence (SEQ ID NO:4) of the 341-1-19 light chain variable region is shown in the Sequence Listing.

The translation initiation site of the heavy chain nucleotide sequence is ATG codon starting with adenine (A) at position 50 from the 5'-terminal of SEQ ID NO:1, and the termination codon is TGA starting with thymine (T) at position 1472. The boundary between the antibody variable region and the constant region is placed between adenine (A) at position 493 from the 5'-terminal and guanine (G) at position 494. In the heavy chain amino acid sequence, the H chain variable region is from the N-terminal of SEQ ID NO:2 to serine (S) residue at position 148, and the constant region is from alanine (A) at position 149. The H chain signal sequence was estimated to be from the N-terminal of SEQ ID NO:2 to serine (S) at position 20 by gene sequence estimation software (Signal P ver. 2). It is considered that the N-terminal of the mature protein is glutamine (Q) at position 21 of SEQ ID NO:2.

The translation initiation site of the light chain nucleotide sequence is ATG codon starting with A at position 29 from the 5'-terminal of SEQ ID NO:3, and the variable region is from the 5'-terminal to adenine (A) at position 400. In the amino acid sequence, the variable region is from the N-terminal of SEQ ID NO:4 to lysine (K) at position 124. It became apparent from the analysis on the N-terminal of purified L chain protein that the L chain signal sequence is from the N-terminal to glycine (G) at position 20 in SEQ ID NO. 4 and that the N-terminal of the mature protein was glutamic acid (E) at position 21 in SEQ ID NO:4.

Example 2

Immunization to Obtain Second Antigen Recognition Site

In order to obtain a second antigen recognition site, an anti-human CD28 antibody was obtained.

The immunization for obtaining the anti-CD28 antibody was carried out in accordance with the method in WO02/088186 which is the method for obtaining the above-mentioned anti-CD40 antibody. Recombinant Human CD28/Fc Chimera (manufactured by R&D system) and MPL+TDM EMULSION (RiBi, manufactured by Sigma-Aldrich, Inc) were mixed at a ratio of 1:1 to immunize a mouse in its right abdominal cavity at 40 µg/mouse. The immunization was carried out three times for every 14 days. In addition, the mouse was immunized with the same antigen three days before harvesting the spleen.

Example 3

Preparation of scFV Library of Anti-CD28 Antibody Comprising the Same Light Chain as that of Anti-CD40 Antibody In order to carry out screening an anti-CD28 antibody comprising the same light chain as that of the anti-CD40 antibody 341-1-19 in Example 1, a library of a single-chain antibody fragment (scFV) in which a heavy chain variable region gene fragment of anti-CD28 antibody is bound to a light chain variable region gene fragment of anti-CD28 antibody, was produced using the spleen of the mouse which was immunized with CD28 produced in Example 2.

The spleen was surgically excised from the immunized mouse, 3 mL of TRIzol Reagent (manufactured by Invitrogen by Life Technologies Corporation) was added thereto, and tissues were then minced by Polytron. Total RNA was extracted from the solution after mince in accordance with the attached explanatory leaflet. Then, cDNA was synthesized by means of Super Script III First-Stand Synthesis System (manufactured by Invitrogen by Life Technologies Corporation) using mRNA which was purified from the Total RNA with oligotex-dT30 (super) mRNA purification kit (manufactured by Takara Bio Inc) as a template. In addition, in the synthesis of cDNA, Random Hexamers included in the kit were used as primers.

Then, the PCR was carried out using DNA polymerase (KOD-Plus, manufactured by Toyobo Co. Ltd.) by repeating 35 cycles of a reaction at 95° C. for 30 seconds, at 58° C. for 30 seconds, and at 68° C. for 1 minute as one cycle to amplify a 341-1-19 heavy chain variable region gene fragment in which the SfiI sequence was added to the 5'-terminal and a glycine-rich sequence added to the 3'-terminal while using the heavy chain (SEQ ID NO:1) of 341-1-19 as a template and 5'-GCAACTGCGGCCCAGCCGGCCATG-GCCCAGGTGCAGCTGCAGGAG-3' (SEQ ID NO:5) and 5'-CCGAGGCGCGCCCACCGCTGCCACCGCCTCCT-GAGGAGACGGTGACCGT-3' (SEQ ID NO:6) as primers, and to amplify of a 341-1-19 light chain variable region gene fragment in which a glycine-rich sequence added to the 5'-terminal and the NodI sequence added to the 3'-terminal while using the light chain of 341-1-19 (SEQ ID NO:3) as a template and the 5'-CGGTGGGCGCGCCTCGGGCG-GAGGTGGTTCAGAAATTGTGTTGACACAG-3' (SEQ ID NO:7) and 5'-CATTCTCGAGTTGCGGCCG-CACGTTTGATATCCACTTTGGTC-3' (SEQ ID NO:8) as primers, respectively. The glycine-rich sequences used in the present invention are shown as SEQ ID NOs:9 and 10. The AscI restriction site was inserted into this glycine-rich sequence. The thus-obtained VH and VL gene fragments were linked to each other by means of Over Extension PCR using the glycine-rich sequence which was added by PCR, to obtain 341-1-19 scFv gene fragment. This gene fragment was digested with SfiI and NotI and inserted into a pCANTAB5E vector (manufactured by GE Healthcare Biosciences Ltd) which had been digested in advance with SfiI and NotI. The obtained plasmid was named pCANTAB5E/341-1-19. Since the purpose of the present invention is to obtain an antibody for an antigen of Human CD28 comprising the same amino acid sequence as that of the light chain of 341-1-19, this plasmid was digested with SfiI and AscI (to remove the gene region encoding VH of 341-1-19), and thereafter, the vector gene which had been dephosphorylated with Alkaline Phosphatase (BAP, manufactured by Takara Bio Inc) to use as a library-producing vector.

The heavy chain variable region gene fragment for producing a phage antibody library was prepared using cDNA derived from the immunized mouse spleen as a template. As a first step, the PCR was carried out by repeating 30 cycles of reaction at 95° C. for 30 seconds, at 58° C. for 30 seconds, and at 68° C. for 30 seconds as one cycle using cDNA as a template and using a primer (one of SEQ ID NOs:11 to 35) specific to the signal region of the human heavy chain and a primer (SEQ ID NO:36) specific to the IgG constant region, and using DNA polymerase (KOD-Plus, manufactured by Toyobo Co. Ltd). As a second step, the PCR was carried out by repeating 35 cycles of reaction at 95° C. for 30 seconds, at 58° C. for 30 seconds, and at 68° C. for 30 seconds as one cycle using these PCR products as templates, using a primer (one of SEQ ID NOs:37 to 56) specific to the variable region of the human heavy chain and a primer (one of SEQ ID NOs:57 to 61) specific to Junction region, and using DNA polymerase (KOD-Plus, manufactured by Toyobo Co. Ltd). In addition, the primer specific to the variable region was selected in accordance with the primer specific to the variable region and used in PCR in the first step, and 5 types of primers specific to the Junction region (the combination of the primers specific to the variable region and the PCR products in the first step is shown in Table 1) were mixed and used for the primer. In addition, the restriction site of SfiI was inserted into the 5'-terminal of each nucleotide sequence represented by any one of SEQ ID NOs:37 to 56, and the restriction site of AscI and the linker sequence were inserted into the 5'-terminal of each nucleotide sequence represented by any one of SEQ ID NOs:57 to 61.

TABLE 1

Combination of the Primers Used for Producing Phage Library

| PCR Reaction (First Step) | | PCR Reaction (Second Step) | |
|---|---|---|---|
| IgG Signal Sequence Primer | Primer specific to IgG Constant Region | Variable Region Primer | Primer Specific to Junction Region |
| SEQ ID NO: 11 | SEQ ID NO: 36 | SEQ ID NO: 37 | SEQ ID NO: 57 + |
| SEQ ID NO: 11 | | SEQ ID NO: 38 | SEQ ID NO: 58 + |
| SEQ ID NO: 12 | | SEQ ID NO: 39 | SEQ ID NO: 59 + |
| SEQ ID NO: 13 | | SEQ ID NO: 40 | SEQ ID NO: 60 + |
| SEQ ID NO: 14 | | SEQ ID NO: 41 | SEQ ID NO: 61 |
| SEQ ID NO: 15 | | SEQ ID NO: 37 | |
| SEQ ID NO: 16 | | SEQ ID NO: 42 | |
| SEQ ID NO: 11 | | SEQ ID NO: 43 | |

TABLE 1-continued

Combination of the Primers Used for Producing Phage Library

| PCR Reaction (First Step) | | PCR Reaction (Second Step) | |
|---|---|---|---|
| IgG Signal Sequence Primer | Primer specific to IgG Constant Region | Variable Region Primer | Primer Specific to Junction Region |
| SEQ ID NO: 17 | | SEQ ID NO: 44 | |
| SEQ ID NO: 18 | | SEQ ID NO: 45 | |
| SEQ ID NO: 19 | | SEQ ID NO: 46 | |
| SEQ ID NO: 20 | | SEQ ID NO: 47 | |
| SEQ ID NO: 21 | | SEQ ID NO: 48 | |
| SEQ ID NO: 22 | | SEQ ID NO: 46 | |
| SEQ ID NO: 21 | | SEQ ID NO: 46 | |
| SEQ ID NO: 23 | | SEQ ID NO: 46 | |
| SEQ ID NO: 21 | | SEQ ID NO: 49 | |
| SEQ ID NO: 24 | | SEQ ID NO: 47 | |
| SEQ ID NO: 25 | | SEQ ID NO: 46 | |
| SEQ ID NO: 26 | | SEQ ID NO: 46 | |
| SEQ ID NO: 27 | | SEQ ID NO: 46 | |
| SEQ ID NO: 28 | | SEQ ID NO: 46 | |
| SEQ ID NO: 29 | | SEQ ID NO: 50 | |
| SEQ ID NO: 29 | | SEQ ID NO: 52 | |
| SEQ ID NO: 30 | | SEQ ID NO: 51 | |
| SEQ ID NO: 31 | | SEQ ID NO: 50 | |
| SEQ ID NO: 32 | | SEQ ID NO: 50 | |
| SEQ ID NO: 33 | | SEQ ID NO: 53 | |
| SEQ ID NO: 34 | | SEQ ID NO: 54 | |
| SEQ ID NO: 35 | | SEQ ID NO: 55 | |
| SEQ ID NO: 31 | | SEQ ID NO: 56 | |

The VH gene fragments amplified by PCR were mixed, digested with SfiI and AscI, and then inserted into the library-producing vector by carrying out the reaction at 16° C. overnight using a DNA Ligation Kit (manufactured by Takara Bio Inc). This ligation solution was introduced into TG1 Electroporation Competent Cells (manufactured by SRATAGENE) by electroporation. The transformed Escherichia coli was subjected to shaking culture at 30° C. for one hour in 2×YTAG culture medium (which was prepared by dissolving 17 g of Bactro-tryptone, 10 g of Bact-yeast extract, and 5 g of NaCl with distilled water to be 1 L, and then autoclaving followed by adding 100 μg/mL of ampicilin and 2% glucose thereto), then seeded on an SOBAG culture medium plate (which was prepared by dissolving 20 g of Bactro-tryptone, 5 g of Bact-yeast extract, 15 g of Bacto-agar, 0.5 g of NaCl in 900 mL of distilled water, then autoclaving followed by cooling to 50 to 60° C. to be added 10 mL of sterile 1 M $MgCl_2$, 55.6 mL of sterilized 2 M glucose and Ampicilin) prepared using a standard dish (150×15 mm, manufactured by Becton, Dickinson and Company), and then incubated at 30° C. overnight. The colonies grown on the culture medium were collected (colonies were collected from 3 mL of 2×YTAG culture medium per one plate) as the scFv antibody library. In this Example, approximately $5×10^5$ colonies were collected to produce the library.

The scFv antibody library (100 μL) was subjected to shaking culture on 2×YTAG culture medium (50 mL) at 30° C. until the absorbance at 600 nm reached from 0.3 to 0.5. This culture solution was infected with M13KO helper phage at an MOI of 10 to 20 (subjected to shaking culture at 30° C. for 1 hour), then the culture medium was changed to 2×YTAK (which was prepared by dissolving 17 g of Bacto-tryptone, 10 g of Bact-yeast extract, and 5 g of NaCl with distilled water to 1 L and then autoclaving followed by adding 100 μg/mL of ampicilin and 50 μg/mL of kanamycin), and then the resultant was subjected to shaking culture at 30° C. overnight. The culture supernatant was used as the antibody phage library. The antibody phage library was precipitated with PEG (prepared by adding distilled water to 200 g of polyethylene glycol 8000 and 146.1 g of NaCl to dissolve them to 1 L, followed by autoclaving) and the solution was substituted for 3 mL of PBS (−).

Example 4

Preparation of Human-CD28 Antigen

The human-CD28 (SEQ ID NO:62) was amplified by carrying out 35 cycles of reaction at 95° C. for 30 seconds, at 55° C. for 30 seconds, and at 68° C. for 1 minute as one cycle using Human Spleen Marathon Ready cDNA (Clontech Laboratories Inc) as a template and 5'-ATGCTCAG-GCTGCTCTTGGCTCTCAACTTATTC-3' (SEQ ID NO:63) and 5'-TCAGGAGCGATAGGCTGC-GAAGTCGCG-3' (SEQ ID NO:64) as primers, and using DNA polymerase (KOD-Plus, manufactured by Toyobo Co. Ltd). The expression vector of Fc fusion protein (CD28-FC) of the human-CD28 extracellular domain (SEQ ID NO:65) with IgG was prepared using the above gene fragment as a template. The gene fragment of the human-CD28 extracellular region was obtained, and PCR to add the KpnI sequence to the 5'-terminal and an XbaI sequence to the 3'-terminal, respectively, was carried out. In practice, PCR was carried out by repeating 35 cycles of reaction at 95° C. for 30 seconds, at 55° C. for 30 seconds, and at 68° C. for 30 seconds as one cycle using the human-CD28 cDNA as a template, 5'-GGGGGTACCATGCTCAGGCTGCTCTTG-GCTC-3' (SEQ ID NO:66) and 5'-GGGTCTAGAC-CAAAAGGGCTTAGAAGGTCCG-3' (SEQ ID NO:67) as primers and using DNA polymerase (KOD-Plus, manufactured by Toyobo Co. Ltd). The gene fragment amplified by this PCR was digested with Kpn1 and Xba1 and inserted into pTracer-CMV/Zeo (Invitrogen by Life Technologies Corporation) into which the Fc region of human IgG was inserted in advance. The thus obtained plasmid was named pTracer/hECD28-Fc.

The prepared expression vector plasmid was obtained using Nucleobomd PC2000EF (manufactured by Macherey-NAGEL GmbH & Co. KG) and introduced into nonadherent 293 cells using FreeStyle™ 293 Expression System (Invitrogen by Life Technologies Corporation), and thereby the culture supernatant containing each antibody was obtained by transient expression. The culture supernatant was collected after 7 days from the introduction of the vector and filtered with a membrane filter (manufactured by Millipore Corporation) having a pore diameter of 0.22 μm. This culture supernatant was charged in an antibody-purifying affinity column, HiTrap rProtein A FF (column volume 1 mL) (manufactured by GE Healthcare Bio-sciences Ltd), washed with PBS (−), eluted with buffer of 20 mM sodium citrate and 50 mM NaCl buffer (pH 2.7), and the eluted solution was collected into a tube with 200 mM sodium phosphate buffer (pH 7.0). Thereafter, the obtained solution was charged with the column in which Q-Sepharose (Hitrap Q HP, manufactured by GE Healthcare Bio-sciences Ltd) was linked to SP-Sepharose (HiTrap SP FF, manufactured by GE Healthcare Bio-sciences Ltd) to be absorbed onto the columns and washed with 20 mM sodium phosphate buffer (pH 5.0) to elute with 1×PBS buffer. The eluate was filtered and sterilized with a membrane filter having a pore diameter of 0.22 μm (Millex-GV, manufactured by Millipore Corporation), and thereby recombinant Fc fusion protein was obtained. The concentration of the purified human-CD28-Fc fusion protein was calculated using the absorbance at 280 nm.

Example 5

Concentration of Phage Displaying scFv Antibody which Recognizes Human-CD28

The Human-CD28-Fc fusion protein was prepared to give a concentration of 10 μg/mL with coating buffer (50 mM carbonate buffer, pH 9), then added to the Maxisorp Immuno Tube (star tube type, manufactured by Nalge Nunc International) and incubated at 4° C. overnight to be immobilized. Then, to the tube, 500 mL of blocking reagent (SuperBlock (registered trademark) Blocking Buffer, manufactured by Pierce Protein Research) was added and incubated at a room temperature for 1 hour, so as to be blocked. The resulting tube was washed three times with Washing buffer (0.1% Tween20-TBS). The antibody phage library was incubated with 2 mL of block Ace (manufactured by Dainippon Sumitomo Pharma Co. Ltd) at a room temperature for 2 hours. The obtained antibody phage library was added to the washed tube, and then incubated at room temperature for 2 hours. The resulting tube was washed 10 times with Washing buffer and then eluted with 0.1 M Glycine-HCl solution (pH 2.2). Then, to the eluted solution, 2 M Tris-base solution was added for neutralization. Thus eluted phage was infected again with TG1, and the infected TG1 was seeded on the 2×YTAG culture medium plate followed by incubation at 30° C. overnight. The colonies grown on the culture medium were recovered again to carry out panning a total of three times in accordance with the above method.

Example 6

Selection of Antibody Display Phage which Recognizes Human-CD28 and Production of Anti-CD28 Antibody (341VL34 and 341VL36)

Each single colony obtained from the antibody library to which the panning had been applied was seeded in 200 μL of 2×YTAG culture medium and subjected to a shaking culture at 30° C. for 4 to 5 hours. Then, 200 μL of 1×10^10 pfu/mL M13KO helper phage was added to the culture solution for the infection (the shaking culture at 30° C. for 1 hour). After changing the culture medium to 2×YTAK, the shaking culture was carried out at 30° C. overnight. The binding property to the antigen was examined by the following steps (ELISA) using this culture supernatant as a phage solution.

The human-CD28-Fc fusion protein was diluted with Coating buffer (50 mM carbonate buffer, pH 9) to give a concentration of 2 μg/mL. The obtained solution was put into the Maxisorp Plate (manufactured by Nalge Nunc International) at 50 μL/well and incubated at 4° C. overnight to be immobilized. Then, to the well, 200 μL/well of blocking reagent (SuperBlock (registered trademark) Blocking Buffer, manufactured by Pierce Protein Research) was added, the resulting object was incubated at a room temperature for 30 minutes to complete the blocking. To the well, 50 μL/well of each phage solution was added, and incubated at a room temperature for 1 hour. Each well was washed three times with Washing buffer (0.1% Tween20-TBS). After diluting HRP/Anti-E Tag conjugate (manufactured by GE Healthcare Bio-sciences Ltd) with assay diluent (0.1% Tween20-TBS containing 10% Block Ace manufactured by Dainippon Sumitomo Pharma Co. Ltd), 50 μL/well of the diluted HRP/Anti-E Tag conjugate was added to the each wells followed by incubation at room temperature for 1 hour. After washing each well three times with Washing buffer, 50 μL of TMB (manufactured by Dako) chromogenic substrate solution was added to each well, and incubated in a dark room at a room temperature. After developing color, 0.5 M vitriol (50 μL/well) was added to stop the reaction. The absorbance at the wavelength of 450 nm was measured with a microplate reader (SPECTRAMAX190, manufactured by Molecular Devices Inc).

Two scFv antibodies which were found to bind to the antigen in the ELISA were named 341VL34 scFv and 341VL36 scFv, respectively. In order to change the obtained scFV antibody to the normal type antibody, gene of the antibody was cloned to prepare the expression vector.

The heavy chain gene fragment was amplified by carrying out 30 cycles of reaction at 95° C. for 30 seconds, at 58° C. for 30 seconds, and at 68° C. for 30 seconds as one cycle using pCANTAB/341VL34 or pCANTAB/341VL36 as a template and 5'-AAAGGTGTCCAGTGTGAGGTGCA-GCTGGTGGAGTC-3' (SEQ ID NO:68) and 5'-TGAGGA-GACGGTGACCGTGG-3' (SEQ ID NO:69) as primers and using DNA polymerase (KOD-Plus, manufactured by Toyobo Co. Ltd). PCR was carried out to add the SalI sequence, the Kozac sequence, and the sequence encoding the signal to the 5'-terminal and to add the NheI sequence to the 3'-terminal using each obtained gene fragment as a template. PCR was carried out 35 cycles of reaction at 95° C. for 30 seconds, at 58° C. for 30 seconds, and at 68° C. for 30 seconds as one cycle using the respective heavy chain gene fragments as a template and 5'-GGGGTCGACAC-CATGGAGTTTGGGCTGAGCTGGGTTTTCCTTGTT-GCTATTT TAAAAGGTGTCCAGTGT-3' (SEQ ID NO:70) and 5'-GGGGCTAGCTGAGGAGACGGTGACC-3' (SEQ ID NO:71) as primers and using DNA polymerase (KOD-Plus, manufactured by Toyobo Co. Ltd). Since each of the light chains of 341VL34 scFv and 341VL36 scFv has the same amino acid sequence as that of 341-1-19, the heavy chain variable region of the 341-1-19 expression vector (which is the same as N5KG2Ser disclosed in Japanese Patent Application No. 2003-431408) was cut out with SalI and NheI, and each of the heavy chain gene fragments prepared by digesting 341VL34scFv and 341VL36scFv with SalI and NheI was inserted. The antibody comprising a light chain of 341-1-19 (SEQ ID NO:2) and a heavy chain derived from 341VL34scFv was named 341VL34, and the antibody comprising a light chain of 341-1-19 (SEQ ID NO:2) and a heavy chain derived from 341VL36scFv was named 341VL36.

Each of 341VL34 heavy chain nucleic acid sequence (SEQ ID NO:72), 341VL34 heavy chain amino acid sequence (SEQ ID NO:73), 341VL36 heavy chain nucleic acid sequence (SEQ ID NO:74), and 341VL36 heavy chain amino acid sequence (SEQ ID NO:75) is shown in the Sequence Listing.

The translation initiation site of the 341VL34 antibody heavy chain nucleic acid is ATG codon starting with adenine (A) at position 1 from the 5'-terminal of SEQ ID NO:72, and the termination codon is TGA starting with thymine (T) at position 1417. The boundary between the antibody variable region and the constant region is placed between adenine (A) at position 438 and guanine (G) at position 439 from the 5'-terminal. In the amino acid sequence, the heavy chain variable region is from the N-terminal of SEQ ID NO:73 to serine (S) residue at position 146, and the constant region is from alanine (A) at position 147. It is considered that the heavy chain signal sequence is from the N-terminal of SEQ ID NO:73 to cysteine (C) at position 19 and that the N-terminal of the mature protein is glutamic acid (E) at position 20.

The translation initiation site of the 341VL36 antibody heavy chain nucleic acid is ATG codon starting with adenine (A) at position 1 from the 5'-terminal of SEQ ID NO:74, and the termination codon is TGA starting from thymine (T) at position 1417. The boundary between the antibody variable region and the constant region is placed between adenine (A) at position 438 and guanine (G) at position 439 from the 5'-terminal. In the amino acid sequence, the heavy chain variable region is from the N-terminal of SEQ ID NO:75 to the serine (S) residue at position 146, and the constant region is from alanine (A) at position 147. It is considered that the heavy chain signal sequence is from the N-terminal of SEQ ID NO:75 to cysteine (C) at position 19 and that the N-terminal of the mature protein is glutamic acid (E) at position 20.

Example 7

Structure of Produced Multivalent Antibody

The structural characteristics of the multivalent antibody produced in the present invention are shown in FIG. 1. The variable regions derived from two antibodies are linked via a linker. Using one antibody (341-1-19) as anti-CD40 antibody and two antibodies (341VL34 and 341VL36) as anti-CD28 antibody, an antibody in which the combinations of the structure and the position of the linkers were changed was produced to be examined. As the linker of the multivalent antibody in the Examples, the linker represented by SEQ ID NO:77 comprising the CH1 region of IgG2 subclass derived from 341-1-19 or the linker represented by SEQ ID NO:99 comprising the CH1, hinge, CH2, and CH3 regions was inserted. However, the linker used in the present invention is not limited to these linkers.

Table 2 shows the structures of the produced multivalent antibodies.

TABLE 2

Structures of Multivalent Antibodies

| Name of Multivalent Antibody | Name of Antibody Used at N-terminal Side | Name of Antibody Used at C-terminal Side | SEQ ID NO of Linker | Amino Acid Length of Linker |
| --- | --- | --- | --- | --- |
| 341VL34-CH1-341 | 341VL34 | 341-1-19 | 76, 77 | 100 |
| 341-CH1-341VL34 | 341-1-19 | 341VL34 | 76, 77 | 100 |
| DVD341VL34-341 | 341VL34 | 341-1-19 | 87, 88 | 6 |
| 341VL34-CH1-H-CH2-CH3-341-CH1 | 341VL34 | 341-1-19 | 98, 99 | 328 |
| 341VL36-CH1-341 | 341VL36 | 341-1-19 | 76, 77 | 100 |
| 341-CH1-341VL36 | 341-1-19 | 341VL36 | 76, 77 | 100 |
| DVD341VL36-341 | 341VL36 | 341-1-19 | 87, 88 | 6 |
| 341VL36-CH1-H-CH2-CH3-341-CH1 | 341VL36 | 341-1-19 | 98, 99 | 328 |

Example 8

Preparation of Expression Vector of Multivalent Antibody (341VL34-CH1-341) Comprising Antigen Recognition Site for CD28 (341VL34 Origin) at N-Terminal Side, Antigen Recognition Site for CD40 (341-1-19 Origin) at C-Terminal Side and Linker Represented by SEQ ID NO:77

In order to produce the multivalent antibody comprising the recognition site for CD28 and the recognition site for CD40 in a row in order from the heavy chain N-terminal side, the heavy chain variable region of anti-CD28 antibody 341VL34 was linked in tandem to the heavy chain variable region of anti-CD40 antibody 341-1-19 via the linker (SEQ ID NO:77). Since the same light chain as that of 341-1-19 was used for an anti-CD28 antibody, the expression vector comprised one type of light chain sequence. This multivalent antibody was named 341VL34-CH1-341.

The sequence (SEQ ID NO:76 and 77) comprising the CH1 sequence (positions 118 to 215 of the EU index of Kabat) and the BamHI sequence (GGATCC) at its 3'-terminal was inserted as a linker between the heavy chains (3'-terminal of 341VL34 heavy chain, 5'-terminal of 341-1-19 heavy chain).

The gene sequence encoding the heavy chain of 341VL34-CH1-341 was prepared by the following steps.

The linker gene fragment with the NheI sequence added to the 5'-terminal was amplified by carrying out 30 cycles of reaction at 95° C. for 30 seconds, at 55° C. for 30 seconds, and at 68° C. for 30 seconds as one cycle using the heavy chain sequence of 341-1-19 as the template and 5'-GGGGCTAGCACCAAGGGCCCATC-3' (SEQ ID NO:78) and 5'-GGATCCAACTGTCTTGTCCACCTTGG-3' (SEQ ID NO:79) as primers and using DNA polymerase (KOD-Plus, manufactured by Toyobo Co. Ltd). The heavy chain gene fragment of 341-1-19 with the linker gene (21 bases from 3'-terminal side) added to the 5'-terminal and with NheI sequence added to 3'-terminal was amplified by carrying out 30 cycles of reaction at 95° C. for 30 seconds, at 55° C. for 30 seconds, and at 68° C. for 30 seconds was performed as one cycle using the heavy chain sequence of 341-1-19 as a template and 5'-GTGGACAAGACAGTTG-GATCCCAGGTCCAACTGCAGCAGTC-3' (SEQ ID NO:80) and 5'-CTTGGTGCTAGCTGAGGAGACGGT-GAC-3' (SEQ ID NO:81) as primers and using DNA polymerase (KOD-Plus, manufactured by Toyobo Co. Ltd). The thus obtained two gene fragments were linked with Over Extension PCR, and thereby the gene fragment of linker-341-1-19 heavy chain was prepared. This gene fragment was digested with NheI and then inserted into the 341VL4 expression vector which had been dephosphorylated with Alkaline Phosphatase (BAP, manufactured by Takara Bio Inc) after digesting with NheI.

Each of 341VL34-CH1-341 heavy chain nucleic acid sequence (SEQ ID NO:82) and 341VL34-CH1-341 heavy chain amino acid sequence (SEQ ID NO:83) is shown in the Sequence Listing.

Example 9

Preparation of Expression Vector of Multivalent Antibody (341-CH1-341VL34) Comprising Antigen Recognition Site for CD40 (341-1-194 Origin) at N-Terminal Side, Antigen Recognition Site for CD28 (341VL34 Origin) at C-Terminal Side and Linker Represented by SEQ ID NO:77

In order to produce the multivalent antibody comprising the antigen recognition site for CD40 and the antigen recognition site for CD28 in a row in order from the heavy chain N-terminal side, the heavy chain variable region of 341-1-19 was linked in tandem to the heavy chain variable region of 341VL34 via the linker (SEQ ID NO:77). The same light chain as that of 341-1-19 was used for an anti-CD28 antibody. The sequence (SEQ ID NO:76 and 77) comprising CH1 sequence (positions 118 to 215 of the EU index of Kabat) and the BamHI sequence (GGATCC) added to its 3'-terminal was inserted as a linker between the heavy chains (3'-terminal of 341VL34 heavy chain, 5'-terminal of 341-1-19 heavy chain). This antibody was named 341-CH1-341VL34.

The gene sequence encoding the heavy chain of 341-CH1-341VL was prepared by the following steps.

The linker gene fragment with the NheI sequence added to the 5'-terminal was amplified by carrying out 30 cycles of reaction at 95° C. for 30 seconds, at 55° C. for 30 seconds, and at 68° C. for 30 seconds as one cycle using the heavy chain of 341-1-19 as the template and 5'-GGGGCTAGCAC-CAAGGGCCCATC-3' (SEQ ID NO:78) and 5'-GGATC-CAACTGTCTTGTCCACCTTGG-3' (SEQ ID NO:79) as primers and using DNA polymerase (KOD-Plus, manufactured by Toyobo Co. Ltd). The heavy chain gene fragment of 341-1-19 with the linker gene (21 bases from 3'-terminal) added to the 5'-terminal and with NheI sequence added to the 3'-terminal was amplified by carrying out 30 cycles of reaction at 95° C. for 30 seconds, at 55° C. for 30 seconds, and at 68° C. for 30 seconds as one cycle using the heavy chain sequence of 341VL-34 as a template and 5'-GTGGA-CAAGACAGTTGGATCCGAGGTGCAGCTGGTG-GAGTC-3' (SEQ ID NO:84) and 5'-CTTGGTGCTAGCT-GAGGAGACGGTGAC-3' (SEQ ID NO:81) as primers and using DNA polymerase (KOD-Plus, manufactured by Toyobo Co. Ltd). The thus obtained two gene fragments were linked with Over Extension PCR, and thereby the gene fragment of linker-341VL34 heavy chain was prepared. This gene fragment was digested with NheI and then inserted into the 341-1-19 expression vector which had been dephosphorylated with Alkaline Phosphatase (BAP, manufactured by Takata Bio Inc) after digesting with NheI.

Each of 341-CH1-341VL34 heavy chain nucleic acid sequence (SEQ ID NO:85) and 341-CH1-341VL34 heavy chain amino acid sequence (SEQ ID NO:86) is shown in the Sequence Listing.

Example 10

Preparation of Expression Vector of Multivalent Antibody (DVD341VL34-341) Comprising Antigen Recognition Site for CD28 (341VL34 Origin) at N-Terminal Side, Antigen Recognition Site for CD40 (341-1-19 Origin) at C-Terminal Side and Short Linker Represented by SEQ ID NO:88 which Links Two Antigen Recognition Sites In order to compare the stabilities of the multivalent antibodies, the multivalent antibody in which multiple antigen recognition sites were linked via the linker comprising short amino acid sequence (6 amino acids) was prepared in accordance with the report by Wu et al. (Non-Patent Literature 5). The multivalent antibody using the short linker prepared in accordance with the report by Wu et al. is referred to as DVDIgG. Specifically, the DVDIgG was prepared using anti-CD40 antibody 341-1-19 and anti-CD28 antibody 341VL34. The DVDIgG comprising the antigen recognition site for CD28 and the antigen recognition site for CD40 in order from N-terminal side was named DVD341VL34-341. The 341VL34 variable region was linked in tandem to the N-terminal side of the 341-1-19 heavy chain variable region.

In regard to the light chain, 341VL34 light chain variable region was linked in tandem to the N-terminal side of the light chain variable region of 341-1-19. A partial sequence (SEQ ID NO:89 and 90: positions 108 to 113 of the EU index of Kabat) of the light chain κ constant region was inserted between the variable regions as a linker.

The gene sequence encoding the heavy chain of DVD341VL34-341 was prepared by the following steps.

The heavy chain gene fragment of 341-1-19 with the linker gene sequence (5'-terminal of the linker is the NheI sequence) added to the 5'-terminal and with the NheI sequence added to the 3'-terminal was amplified by carrying out 35 cycles of reaction at 95° C. for 30 seconds, at 55° C. for 30 seconds, and at 68° C. for 30 seconds as one cycle using the heavy chain sequence of 341-1-19 as a template and 5'-GTCTCCTCAGCTAGCACCAAGGGCCCACAG-GTCCAACTGCAGCAGTC-3' (SEQ ID NO:91) and 5'-CT-TGGTGCTAGCTGAGGAGACGGTGAC-3' (SEQ ID NO:81) as primers and using DNA polymerase (KOD-Plus, manufactured by Toyobo Co. Ltd). This gene fragment was digested with NheI and then inserted into the 341VL34 expression vector which had been dephosphorylated with Alkaline Phosphatase (BAP, manufactured by Takara Bio Inc) after digesting with NheI. Furthermore, the light chain prepared by the following method was inserted into this vector.

The gene sequence encoding the light chain of DVD341VL34-341 was prepared by the following steps.

The light chain gene fragment of 341-1-19 with the linker gene sequence (5'-terminal of the linker is the BsiWI sequence) added to the 5'-terminal and with the BsiWI sequence added to the 3'-terminal was amplified by carrying out 35 cycles of reaction at 95° C. for 30 seconds, at 55° C. for 30 seconds, and at 68° C. for 30 seconds as one cycle using the 341-1-19 light chain as the template and 5'-GGGCGTACGGTGGCTGCACCAGAAATTGTGTT-GACACAGTC-3' (SEQ ID NO:92) and 5'-GGGCG-TACGTTTGATATCCACTTTGGTCC-3' (SEQ ID NO:93) as primers and using DNA polymerase (KOD-Plus, manufactured by Toyobo Co. Ltd). This gene fragment was digested with BsiWI and then inserted into the expression vector comprising the above-mentioned DVD341VL34-341-1-19 which had been dephosphorylated with Alkaline Phosphatase (BAP, manufactured by Takara Bio Inc) after digesting with BsiWI.

Each of DVD341VL34-341 heavy chain nucleic acid sequence (SEQ ID NO:94), DVD341VL34-341 heavy chain amino acid sequence (SEQ ID NO:95), DVD341VL34-341 light chain nucleic acid sequence (SEQ ID NO:96), and DVD341VL34-341 light chain amino acid sequence (SEQ ID NO:97) is shown in the Sequence Listing.

Example 11

Preparation of Expression Vector of Multivalent Antibody (341VL34-CH1-H—CH2-CH3-341-CH1) Comprising Antigen Recognition Site for CD28 (341VL34 Origin) at N-Terminal Side, Antigen Recognition Site for CD40 (341-1-19 Origin) at C-Terminal Side and Linker Represented by SEQ ID NO:99

The multivalent antibody comprising the CD28 recognition site and the CD40 recognition site in order from the heavy chain N-terminal side and comprising the long linker represented by SEQ ID NO:98 or 99 (CH1, hinge, CH2, CH3: positions 118 to 447 of the EU index of Kabat) was prepared. Specifically, the variable region of 341VL34 was linked to the variable region of 341-1-19 via the linker represented by SEQ ID NO:98 or 99. To 3'-terminal, TGA was added as a termination codon. The same light chain as that of 341-1-19 was used for the anti-CD28 antibody. This antibody was named 341VL34-CH1-H—CH2-CH3-341-CH1.

The gene sequence encoding the heavy chain of 341VL34-CH1-H—CH2-CH3-341-CH1 was prepared by the following steps.

The linker gene fragment (5'-terminal of the linker is the NheI sequence) with the BamHI sequence added to the 3'-terminal was amplified by carrying out 35 cycles of reaction at 95° C. for 30 seconds, at 55° C. for 30 seconds, and at 68° C. for 30 seconds as one cycle using the 341-1-19 heavy chain sequence as the template and the 5'-GTCTC-CTCAGCTAGCACCAAGGGCCCA-3' (SEQ ID NO:100) and 5'-GGGGGATCCTTTACCCGGAGACAGGGAGAG-3' (SEQ ID NO:101) as primers and using DNA polymerase (KOD-Plus, manufactured by Toyobo Co. Ltd). The thus obtained gene fragment was digested with NheI and BamHI and then inserted into the 341VL34 expression vector by digesting with NheI and BamHI to remove the gene region encoding the heavy chain constant region. PCR was carried out 35 cycles of reaction at 95° C. for 30 seconds, at 55° C. for 30 seconds, and at 68° C. for 30 seconds as one cycle using the 341-1-19 heavy chain as a template and 5'-GA-TATCAAAGGATCCCAGGTCCAACTGCAGCAGTC-3' (SEQ ID NO:102) and 5'-GGGGGATCCTCAAACTGTCT-TGTCCACCTTGG-3' (SEQ ID NO:103) as primers and using DNA polymerase (KOD-Plus, manufactured by Toyobo Co. Ltd). The obtained 341-1-19 heavy chain variable region in which the BamHI sequence was added at 5'-terminal end and the BamHI sequence, the termination codon, and the CH1 region (from adenine at position 118 to valine at position 215) (from 3'-terminal) were added at 3'-terminal; and the CH1 region were digested with BamHI and inserted into the 3'-terminal of this expression vector.

Each of 341VL34-CH1-H—CH2-CH3-341-CH1 heavy chain nucleic acid sequence (SEQ ID NO:104) and 341VL34-CH1-H—CH2-CH3-341-CH1 heavy chain amino acid sequence (SEQ ID NO:105) is shown in the Sequence Listing.

Example 12

Preparation of Expression Vector of Multivalent Antibody (341VL36-CH1-341) Comprising Antigen Recognition Site for CD28 (341VL36 Origin) at N-Terminal Side, Antigen Recognition Site for CD40 (341-1-19 Origin) at C-Terminal Side and Comprising Linker Represented by SEQ ID NO:77

In order to produce the multivalent antibody comprising the CD28 recognition site and the CD40 recognition site in a row in order from the heavy chain N-terminal side, the heavy chain variable region of 341VL36 was linked to the heavy chain variable region of 341-1-19 in tandem via the linker represented by SEQ ID NO:77. Since the same light chain as that of 341-1-19 is used for the anti-CD28 antibody, the expression vector comprises one light chain sequence. This multivalent antibody was named 341VL36-CH1-341.

The sequence (SEQ ID NO:76 or 77) comprising CH1 sequence (positions 118 to 215 of the EU index of Kabat) and the BamHI sequence (GGATCC) added to its 3'-terminal was inserted as a linker between the heavy chains (3'-terminal of 341VL34 heavy chain, 5'-terminal of 341-1-19 heavy chain).

The gene sequence encoding the heavy chain of 341VL34-CH1-341 was prepared by the following steps.

The linker gene fragment with the NheI sequence added to the 5'-terminal was amplified by carrying out 30 cycles of reaction at 95° C. for 30 seconds, at 55° C. for 30 seconds, and at 68° C. for 30 seconds as one cycle using the 341-1-19 heavy chain sequence as a template and 5'-GGGGCTAG-CACCAAGGGCCCATC-3' (SEQ ID NO:78) and 5'-GGATCCAACTGTCTTGTCCACCTTGG-3' (SEQ ID NO:79) as primers and using DNA polymerase (KOD-Plus, manufactured by Toyobo Co. Ltd). The reaction at 95° C. for 30 seconds, at 55° C. for 30 seconds, and at 68° C. for 30 seconds was performed over 30 cycles to amplify heavy chain gene fragment of 341-1-19 with the linker sequence (21 bases from 3'-terminal side) added to the 5'-terminal and with the NheI sequence added to the 3'-terminal while using the 341-1-19 heavy chain sequence as a template and 5'-GTGGACAAGACAGTTGGATCCCAGGTCCAACT-GCAGCAGTC-3' (SEQ ID NO:80) and 5'-CTTGGT-GCTAGCTGAGGAGACGGTGAC-3' (SEQ ID NO:81) as primers and using DNA polymerase (KOD-Plus, manufactured by Toyobo Co. Ltd). The thus obtained two gene fragments were linked with Over Extension PCR, and thereby the gene fragment of linker-341-1-19 heavy chain was produced. This gene fragment was digested with NheI and then inserted into the 341VL36 expression vector which had been dephosphorylated with Alkaline Phosphatase (BAP, manufactured by Takara Bio Inc) after digesting with NheI.

Each of 341VL36-CH1-341 heavy chain nucleic acid sequence (SEQ ID NO:106) and 341VL36-CH1-341 heavy chain amino acid sequence (SEQ ID NO:107) is shown in the Sequence Listing.

Example 13

Production of Expression Vector of Multivalent Antibody (341-CH1-341VL36) comprising Antigen Recognition Site for CD40 (341-1-19 Origin) at N-terminal Side and Antigen Recognition Site for CD28 (341VL36 Origin) at C-terminal Side and Linker represented by SEQ ID NO:77

In order to produce the multivalent antibody comprising the CD40 recognition site and the CD28 recognition site in a row in order from the heavy chain N-terminal side, the heavy chain variable region of 341-1-19 was linked to the heavy chain variable region of 341VL36 in tandem via the linker represented by SEQ ID NO:77. The same light chain as that of 341-1-19 is used for the anti-CD28 antibody. The sequence (SEQ ID NO:76 and 77) with the CH1 sequence (positions 118 to 215 of the EU index of Kabat) and the BamHI sequence (GGATCC) added to its 3'-terminal was inserted between the heavy chains (3'-terminal of 341VL36 heavy chain, 5'-terminal of 341-1-19 heavy chain) as a linker. This antibody was named 341-CH1-341VL36.

The gene sequence encoding the 341-CH1-341VL36 heavy chain was produced by the following steps.

The linker gene fragment with the NheI sequence added to the 5'-terminal was amplified by carrying out 30 cycles of reaction at 95° C. for 30 seconds, at 55° C. for 30 seconds, and at 68° C. for 30 seconds as one cycle using the 341-1-19 heavy chain sequence as a template and 5'-GGGGCTAG-CACCAAGGGCCCATC-3' (SEQ ID NO:78) and 5'-GGATCCAACTGTCTTGTCCACCTTGG-3' (SEQ ID NO:79) as primers and using DNA polymerase (KOD-Plus, manufactured by Toyobo Co. Ltd). The heavy chain gene fragment of 341-1-19 with the linker gene (21 bases from 3'-terminal side) added to the 5'-terminal and with the NheI sequence added to the 3'-terminal was amplified by carrying out 30 cycles of reaction at 95° C. for 30 seconds, at 55° C. for 30 seconds, and at 68° C. for 30 seconds as one cycle using the 341VL36 as the template and 5'-GTGGA-CAAGACAGTTGGATCCGAGGTGCAGCTGGTG-GAGTC-3' (SEQ ID NO:84) and 5'-CTTGGTGCTAGCT-GAGGAGACGGTGAC-3' (SEQ ID NO:81) as primers and using DNA polymerase (KOD-Plus, manufactured by Toyobo Co. Ltd). The thus obtained two gene fragments were linked with Over Extension PCR, and thereby the gene fragment of linker-341VL36 heavy chain was prepared. This gene fragment was digested with NheI and then inserted into the 341-1-19 expression vector which had been dephosphorylated with Alkaline Phosphatase (BAP, manufactured by Takara Bio Inc) after digesting with NheI.

Each of 341-CH1-341VL36 heavy chain nucleic acid sequence (SEQ ID NO:108) and 341-CH1-341VL36 heavy chain amino acid sequence (SEQ ID NO:109) is shown in the Sequence Listing.

Example 14

Production of Expression Vector of Multivalent Antibody (DVD341VL36-341) comprising Antigen Recognition Site for CD28 (341VL36 Origin) at N-terminal Side, Antigen Recognition Site for CD40 (341-1-19 Origin) at C-terminal Side and Short Linker represented by SEQ ID NO:88 which links Two Antigen Recognition Sites In order to compare the stabilities of the multivalent antibodies, the DVD-IgG was produced using 341-1-19 and 341VL36 antibodies in accordance with the report by Wu et al. (Non-Patent Literature 5). The DVDIgG comprising the antigen recognition site for CD28 and the antigen recognition site for CD40 in order from the N-terminal side was named DVD341VL36-341. The 341VL34 variable region was linked in tandem to the N-terminal side of the 341-1-19 heavy chain variable region. The linker comprising 6 amino acids and represented by SEQ ID NO:87 or 88, were inserted between the variable regions.

As for the light chain, the 341VL36 light chain variable region was linked in tandem to the N-terminal side of the light chain variable region of the 341-1-19. The partial sequence (SEQ ID NO:89 or 90: positions 108 to 113 of the EU index of Kabat) of the light chain κ constant region was inserted as a linker between the variable regions.

The gene sequence encoding the heavy chain of DVD341VL36-341 was prepared by the following steps.

The heavy chain gene fragment of the 341-1-19 with the linker gene sequence added to the 5'-terminal and with the NheI sequence added to the 3'-terminal side was amplified by carrying out 35 cycles of reaction at 95° C. for 30 seconds, at 55° C. for 30 seconds, and at 68° C. for 30 seconds as one cycle using the 341-1-19 heavy chain sequence as a template and 5'-GTCTCCTCAGCTAGCAC-CAAGGGCCCACAGGTCCAACTGCAGCAGTC-3' (SEQ ID NO:91) and 5'-CTTGGTGCTAGCTGAGGA-GACGGTGAC-3' (SEQ ID NO:84) as primers and using DNA polymerase (KOD-Plus, manufactured by Toyobo Co. Ltd). This gene fragment was digested with NheI and then inserted into the 341VL36 expression vector which had been dephosphorylated with Alkaline Phosphatase (BAP, manufactured by Takara Bio Inc) after digesting with NheI. Furthermore, the light chain which had been prepared by the following method was inserted into this vector.

The gene sequence encoding the DVD341VL36-341 light chain was prepared by the following steps.

The light chain gene fragment 341-1-19 with the linker sequence added to the 5'-terminal and with the BsiWI sequence added to the 3'-terminal was amplified by carrying out the reaction at 95° C. for 30 seconds, at 55° C. for 30 seconds, and at 68° C. for 30 seconds was performed over 35 cycles to amplify as one cycle using the 341-1-19 light chain sequence as a template and 5'-GGGCGTACGGTG-GCTGCACCAGAAATTGTGTTGACACAGTC-3' (SEQ ID NO:92) and 5'-GGGCGTACGTTTGATATCCACTTTG-GTCC-3' (SEQ ID NO:93) as primers and using DNA polymerase (KOD-Plus, manufactured by Toyobo Co. Ltd). This gene fragment was digested with BsiWI and then inserted into the expression vector comprising the above-mentioned heavy chain of DVD341VL36-341 which had been dephosphorylated with Alkaline Phosphatase (BAP, manufactured by Takara Bio Inc) after digesting with BsiWI.

Each of DVD341VL36-341 heavy chain nucleic acid sequence (SEQ ID NO:110), DVD341VL36-341 heavy chain amino acid sequence (SEQ ID NO:111), DVD341VL36-341 light chain nucleic acid sequence (SEQ ID NO:112), and DVD341VL36-341 light chain nucleic acid sequence (SEQ ID NO:113) is shown in the Sequence Listing.

Example 15

Production of Expression Vector of Multivalent Antibody (341VL36-CH1-H—CH2-CH3-341-CH1) comprising Antigen Recognition Site for CD28 (341VL34 Origin) at N-terminal Side, Antigen Recognition Site for CD40 (341-1-19 Origin) at C-terminal Side and Linker represented by SEQ ID NO:99

The multivalent antibody comprising the CD28 recognition site and the CD40 recognition site in order from the heavy chain N-terminal side and comprising the long linker represented by SEQ ID NO:99 was prepared. The heavy chain variable region of 341-1-19 was linked in tandem to the 341VL36 heavy chain variable region via the linker represented by SEQ ID NO:98 or 99. To the 3'-terminal, TGA was added as a termination codon. The same light chain as that of 341-1-19 was used for the anti-CD28 antibody. This antibody was named 341VL36-CH1-H—CH2-CH3-341-CH1.

The gene sequence encoding the heavy chain of 341VL36-CH1-H—CH2-CH3-341-CH1 was prepared by the following steps.

The linker gene fragment with the BamHI sequence added to the 3'-terminal was amplified by carrying out 35 cycles of reaction at 95° C. for 30 seconds, at 55° C. for 30 seconds, and at 68° C. for 30 seconds as one cycle using the 341-1-19 heavy chain sequence as a template and 5'-GTCTCCTCA-GCTAGCACCAAGGGCCCA-3' (SEQ ID NO:100) and 5'-GGGGGATCCTTTACCCGGAGACAGGGAGAG-3' (SEQ ID NO:101) as primers and using DNA polymerase (KOD-Plus, manufactured by Toyobo Co. Ltd). The thus obtained gene fragment was digested with NheI and BamHI and then inserted into the 341VL36 expression vector digested with NheI and BamHI. PCR was carried out 35 cycles of reaction at 95° C. for 30 seconds, at 55° C. for 30 seconds, and at 68° C. for 30 seconds as one cycle using the 341-1-19 heavy chain sequence as a template and 5'-GA-TATCAAAGGATCCCAGGTCCAACTGCAGCAGTC-3' (SEQ ID NO:102) and 5'-GGGGGATCCTCAAACTGTCT-TGTCCACCTTGG-3' (SEQ ID NO:103) as primers and using DNA polymerase (KOD-Plus, manufactured by Toyobo Co. Ltd) to prepare the heavy chain variable region of 341-1-19 with the gene sequence added to the BamHI sequence at the 5'-terminal and added to the nucleotide sequence encoding the BamHI sequence, the termination codon, and the CH1 region (Thr at position 118 to valine at position 215) (from the 3'-terminal) at the 3'-terminal and the CH1 region. The obtained gene fragment was digested with BamHI and inserted to the expression vector. Each of 341VL36-CH1-H—CH2-CH3-341-CH1 heavy chain nucleic acid sequence (SEQ ID NO:114) and 341VL36-CH1-H—CH2-CH3-341-CH1 heavy chain amino acid sequence (SEQ ID NO:115) is shown in the Sequence Listing.

Example 16

Expression and Purification of Multivalent Antibody

The produced expression vector gene was prepared using QIAGEN Plasmid Maxi Kit (manufactured by Qiagen) and introduced into nonadherent 293 cells using FreeStyle™ 293 Expression System (Invitrogen by Life Technologies Corporation). The culture supernatant containing the respective antibodies was obtained by transient expression. The culture supernatant was collected 7 days after the introduction of the vector and filtered with a membrane filter (manufactured by Millipore Corporation) having a pore diameter of 0.22 μm. The affinity purification was carried out the culture supernatant using Protein A resin (MabSelect, manufactured by GE Healthcare Bio-sciences Ltd). Phosphate buffer was used as washing buffer, and buffer of 20 mM sodium citrate and 50 mM NaCl (pH 2.7) was used as an elution buffer. The elution fraction was adjusted to be approximately pH 6.0 by adding 200 mM sodium phosphate buffer (pH 7.0). The adjusted antibody solution was substituted with the phosphate buffer using a dialysis membrane (10000 cuts, manufactured by Spectrum Laboratories Inc), filtered and sterilized with a membrane filter having a pore diameter of 0.22 μm (Millex-GV; manufactured by Millipore Corporation) to obtain a purified antibody. In regard to the density of the purified antibody, the absorbance at 280 nm was measured, and the density of 1 mg/mL antibody was assumed to be 1.40 Optimal Density for the calculation.

Example 17

Measurement of Antibody Productivity

The antibody content in each culture supernatant was measured to know the productivity of the antibody. In order to measure the antibody content, the analysis was carried out using a high performance liquid chromatography apparatus (manufactured by Hitachi Ltd) and POROS 50A (manufactured by Applied Biosystems, cat. 4319037) and using 20 mM phosphate and 300 mM NaCl pH 7.0 as a solvent. The antibody content was calculated by comparing the peak areas obtained by injecting each culture supernatant to the peak areas obtained by injecting 1, 2, 5, and 10 μg, respectively, of purified human antibody (IgG1).

The result is shown in Table 3. It was found from Table 3 that the productivity of a multivalent antibody linked via a shorter linker is lower.

TABLE 3

Productivity of Respective Antibodies

| Antibody | Antibody Density in Culture Supernatant | | Amino Acid Number of Linker |
|---|---|---|---|
| | μg/mL | nM | |
| 341-1-19 | 3.94 | 26.87 | — |
| 341VL34 | 2.5 | 17.23 | — |
| 341VL36 | 2.85 | 19.60 | — |
| 341VL34-CH1-341 | 5.47 | 22.73 | 100 |
| 341-CH1-341VL34 | 6.22 | 25.85 | 100 |
| DVD341VL34-341 | 0.99 | 4.98 | 6 |
| 341VL34-CH1-H-CH2-CH3-341-CH1 | 4.67 | 19.41 | 328 |
| 341VL36-CH1-341 | 6.1 | 25.32 | 100 |
| 341-CH1-341VL36 | 6.47 | 26.85 | 100 |
| DVD341VL36-341 | 1.1 | 5.53 | 6 |
| 341VL36-CH1-H-CH2-CH3-341-CH1 | 4.78 | 19.84 | 328 |

Example 18

Evaluation of Antibody Stability

In order to measure an aggregate content rate of the antibody solution, the analysis was carried out using a high-performance liquid chromatography apparatus (manufactured by Shimadzu Corporation) and TSK-G3000 SW column (manufactured by Tosoh Corporation) and using 20 mM sodium phosphate and 500 mM NaCl pH 7.0 as a solvent. The aggregate content rate was calculated by injecting 40 μg of each antibody to compare the peak position of it to that of a molecular weight marker for gel filtration HPLC (manufactured by Oriental Yeast Co. Ltd, Cat No. 40403701), and specifying the peaks of a monomer of antibody protein and the aggregate other than the antibody protein to calculate the concentration of the aggregate.

The result is shown in Table 4. It was found from Table 4 that with the shorter linker, more aggregate was generated in the purification process and the stability of the multivalent antibody in the aqueous solution was degraded.

TABLE 4

Aggregate Containing Amount of Respective Purified Antibodies

| Antibody | Antibody content (%) | Amino Acid Number of Linker |
|---|---|---|
| 341VL34-CH1-341 | 1.01 | 100 |
| 341-CH1-341VL34 | 2.11 | 100 |
| DVD341VL34-341 | 28.3 | 6 |
| 341VL34-CH1-H-6CH2-CH3-341-CH1 | 0.86 | 328 |

Example 19

Evaluation of Antigen Binding Property of Antibody

The binding property of the prepared antibody comprising two (CD40 and CD28) recognition sites for each antigen was examined by the following steps.

The human-CD40-Fc fusion protein and the human-CD28-Fc fusion protein were adjusted to give a concentration of 1 μg/mL using coating buffer (50 mM carbonate buffer, pH 9). To a well, 50 μL/well of the obtained human-CD40-Fc fusion protein or the obtained human-CD28-Fc fusion protein was added into the Maxisorp Plate (manufactured by Nalge Nunc International) respectively, and incubated at 4° C. overnight to be immobilized. Then, 200 μL/well of blocking reagent (SuperBlock (registered trademark) Blocking Buffer, manufactured by Pierce Protein Research) was added to the well, followed by incubation at room temperature for 30 minutes for blocking. Then, 50 μL/well of the culture supernatant comprising each antibody obtained in above Examples was added to the well followed by incubation at room temperature for 1 hour. After washing three times with Washing buffer (0.1% Tween20-TBS), Affinity Isolated Antibody HRP Conjugated Goat F(ab)$_2$ anti-Human κ (manufactured by EY Laboratories Inc) was diluted with assay diluent (0.1% Tween20-TBS containing Block Ace manufactured by Dainippon Sumitomo Pharma Co. Ltd. by 10%). Then, 50 μL of the obtained solution was added to each well followed by incubation at a room temperature for 1 hour. After washing three times with washing buffer, 50 μL of TMB (manufactured by Dako) coloring substrate solution was added to each well, followed by incubation in a dark room at room temperature. After developing color, 0.5 M vitriol (50 μL/well) was added to stop the reaction. The absorbance at the wavelength of 450 nm was measured with a microplate reader (SPECTRA-MAX190, manufactured by Molecular Devices Inc).

TABLE 5

Binding of Antibody against Antigen

| Antibody | Solid-Phase Antigen | |
|---|---|---|
| | human CD40 | human CD28 |
| 341-1-19 | ○ | X |
| 341VL34 | X | ○ |
| 341VL36 | X | ○ |
| 341VL34-CH1-341 | ○ | ○ |
| 341-CH1-341VL34 | ○ | ○ |
| DVD341VL34-341 | ○ | ○ |
| 341-CH1-H-CH2-CH3-341VL34-CH1 | ○ | ○ |
| 341VL36-CH1-341 | ○ | ○ |
| 341-CH1-341VL36 | ○ | ○ |
| DVD341VL36-341 | ○ | ○ |
| 341VL36-CH1-H-CH2-CH3-341-CH1 | ○ | ○ |

Example 20

Preparation of First Antigen Recognition Site

In the same manner as in Example 1, an anti-CD40 antibody 281 was established as a new anti-CD40 antibody.

Example 21

Preparation of scFV Library of Anti-CD28 Antibody Comprising the Same Light Chain as the Light Chain of Anti-CD40 Antibody In order to carry out the screening of an anti-CD28 antibody having the same light chain as that of the anti-CD40 antibody 281 in Example 20, a library of a single-chain antibody fragments (scFV) in which the heavy chain variable region gene fragment was linked with the light chain variable region gene fragment of the anti-CD28 antibody, was prepared using the spleen of the CD28 immunized mouse prepared in Example 2.

The heavy chain variable region gene fragment of the 281 with the SfiI sequence added to the 5'-terminal and with a glycine-rich sequence added to the 3'-terminal was amplified by carrying out the 35 cycles of reaction at 95° C. for 30 seconds, at 58° C. for 30 seconds, and at 68° C. for 1 minute as one cycle using the heavy chain (SEQ ID NO:116) of the 281 as a template and 5'-GCAACTGCGGCCCAGCCGGC-CATGGCCCAGGTGCAGCTGCAGGAG-3' (SEQ ID NO:120) and 5'-CCGAGGCGCGCCCACCGCTGCCAC-CGCCTCCTGAGGAGACGGTGACCAG-3' (SEQ ID NO:121) as primers and using DNA polymerase (KOD-Plus, manufactured by Toyobo Co. Ltd). The light-chain variable region gene fragment of the 281 with a glycine-rich sequence added to the 5'-terminal and with the NotI sequence added to the 3'-terminal was amplified using the light chain (SEQ ID NO:118) of the 281 as a template and 5'-CGGTGGGCGCGCCTCGGGCGGAGGTGGTTCA-GAAATTGTGTTGACGCAG-3 (SEQ ID NO:122) and 5'-GAGTCATTCTCGACTTGCGGCCGCACGTTT-GATCTCCAGTCGTGTCCC-3' (SEQ ID NO:123) as primers and using DNA polymerase (KOD-Plus, manufactured by Toyobo Co. Ltd). The thus obtained VH was linked with and VL gene fragments with Over Extension PCR in the same manner as in Example 3, and thereby 281 scFv gene fragment was prepared. This gene fragment was digested with SfiI and NotI and inserted into pCANTAB 5E vector (manufactured by GE Healthcare Bio-Sciences Ltd) which had been digested in advance with SfiI and NotI. The obtained plasmid was named pCANTAB5E/281. Since the purpose of this Example is to obtain an antibody for human CD28 as an antigen comprising the same amino acid sequence as that of the light chain of the 281, this plasmid was digested with SfiI and AscI (gene region encoding VH of 341-1-19 was removed). The obtained vector was dephosphorylated with Alkaline Phosphatase (BAP, manufactured by Takara Bio Inc) to be used for a library-producing vector.

The heavy chain variable region gene fragment for producing the phage antibody library was obtained using cDNA synthesized in Example 3 as a template. PCR was carried out 35 cycles of reaction at 95° C. for 30 seconds, at 58° C. for 30 seconds, and at 68° C. for 30 seconds as one cycle using this cDNA as a template, a primer (SEQ ID NOs:124 to 131) specific to the variable region of the human heavy chain, and a primer (SEQ ID NOs:132 to 135) specific to the Junction region, and using DNA polymerase (KOD-Plus, manufactured by Toyobo Co. Ltd). In addition, 5 types of primers specific to the Junction region were used together. Moreover, the restriction site of SfiI was inserted into the 5'-terminal of SEQ ID NOs:124 to 131, respectively, and the restriction site of AscI and the linker sequence were inserted to the 5'-terminal of SEQ ID NOs:132 to 135, respectively.

These VH gene fragments amplified by PCR were inserted into the vector prepared using pCANTAB5E/281 in the same manner as Example 3 to prepare an scFv antibody library. In this Example, approximately $5 \times 10^5$ colonies were collected to prepare the library. The antibody phage library was prepared from this scFv antibody library.

Example 22

Concentration of Phage Displaying svFv Antibody which Recognizes Human-CD28

The concentrating of the antibody phage library prepared in Example 21 was prepared in the same manner as Example 5.

Example 23

Selection of Antibody Display Phage which Recognizes Human-CD28 and Preparation of Anti-CD28 Antibody (281VL4)

The selection of the antibody display phage was carried out in the same manner as Example 6.

The scFv antibody which was found to bind to the antigen by ELISA was named 281VL4 scFv. In order to substitute the obtained scFv antibody with a normal type antibody, the cloning of the antibody gene was carried out and then the expression vector was prepared.

A heavy chain gene fragment was amplified by carrying out 30 cycles of reaction at 95° C. for 30 seconds, at 58° C. for 30 seconds, and at 68° C. for 30 seconds as one cycle using pCANTAB/281VL4 as a template and 5'-CTGCTG-GTGGCGGCTCCCAGATGGGTCCTGTCCGAGGTC-CAGCTGGTG-3' (SEQ ID NO:136) and 5'-TGAGGA-GACGGTGACCA-3' (SEQ ID NO:137) as primers and using DNA polymerase (KOD-Plus, manufactured by Toyobo Co. Ltd). Then, in order to add the SalI sequence, the Kozac sequence, and the sequence encoding the signal to the 5'-terminal thereof and add the NheI sequence to the 3'-terminal thereof, the PCR was carried out using this gene fragment as a template. PCR was carried out 35 cycles of reaction at 95° C. for 30 seconds, at 58° C. for 30 seconds, and at 68° C. for 30 seconds as one cycle using the respective heavy chain gene fragments as a template and 5'-GGGGTCGACACCATGAAGCACCTGTGGTTCTTC-CTCCTGCTGGTGGCGG-3' (SEQ ID NO:138) and 5'-GGGGCTAGCTGAGGAGACGGTGACCA-3' (SEQ ID NO:139) as primers and using DNA polymerase (KOD-Plus, manufactured by Toyobo Co. Ltd). Since the light chain of the 281VL4 scFv has the same amino acid sequence as that of the 281, the 281 expression vector (using N5KG4PE disclosed in WO2002/088186) was digested with SalI and NheI to cut out the heavy chain variable region. The heavy chain gene fragment of the 281VL4 scFv which was obtained by digesting with SalI and NheI, was inserted. The antibody comprising the light chain of the 281 (SEQ ID NO:118 and 119) and the heavy chain of the 281VL4 scFv was named 281VL4.

Each of the 281VL4 heavy chain nucleic acid sequence (SEQ ID NO:140) and the 281VL4 heavy chain amino acid sequence (SEQ ID NO:141) is shown in the Sequence Listing.

The translation initiation site of the 281VL4 antibody heavy chain nucleic acid is ATG codon starting from adenine (A) at position 1 and the termination codon is TGA starting from thymine (T) at position 1417 from 5'-terminal of SEQ ID NO:140. The boundary between the antibody variable region and the constant region is placed between adenine (A) at position 435 and guanine (G) at position 436 from 5'-terminal. In the amino acid sequence, the heavy chain variable region is from the N-terminal to the serine (S) residue at position 145 of SEQ ID NO:141, and the constant region is after alanine (A) at position 146. It is considered that the heavy chain signal sequence is from the N-terminal to serine (S) at position 19 of SEQ ID NO:141 and that the N-terminal of the mature protein is glutamic acid (E) at position 20.

Example 24

Preparation of Expression Vectors of Multivalent Antibody (281VL4-CH1-281, 281VL4-CH1(118-131)-281, 281VL4-CH1(118-130)-281) Comprising Antigen Recognition Site for CD28 (281VL4 Origin) at N-Terminal Side, Antigen Recognition Site for CD40 (281 Origin) at C-Terminal Side and Linker in Table 6

In order to prepare a multivalent antibody comprising the recognition site for CD28 and the recognition site for CD40 in order from the N-terminal side of the heavy chain, the heavy chain variable region of anti-CD28 antibody 281VL4 was linked in tandem to the heavy chain variable region of anti-CD40 antibody 281 from the N-terminal side via a linker shown in Table 6. Since the same light chain as that of 281 is used for the anti-CD28 antibody, the expression vector comprises one type of light chain sequence. These antibodies were named 281VL4-CH1-281, 281VL4-CH1(118-131)-281, and 281VL4-CH1(118-130)-281, respectively.

TABLE 6

Linker Structures of Multivalent Antibody Linker

| Name | Amino Acid Sequence | Base Sequence |
| --- | --- | --- |
| CH1 | ASTKGPSVFPLAPC SRSTSESTAALGCL VKDYFPEPVTVSWN SGALTSGVHTFPAV LQSSGLYSLSSVVT | GCTAGCACCAAGGGGCCATCCGT CTTCCCCCTGGCGCCCTGCTCCA GGAGCACCTCCGAGAGCACAGCC GCCCTGGGCTGCCTGGTCAAGGA CTACTTCCCCGAACCGGTGACGG |

TABLE 6-continued

Linker Structures of Multivalent Antibody Linker

| Name | Amino Acid Sequence | Base Sequence |
| --- | --- | --- |
| | VPSSSLGTKTYTCN VDHKPSNTKVDKRV GS (SEQ ID NO: 377) | TGTCGTGGAACTCAGGCGCCCTG ACCAGCGGCGTGCACACCTTCCC GGCTGTCCTACAGTCCTCAGGAC TCTACTCCCTCAGCAGCGTGGTG ACCGTGCCCTCCAGCAGCTTGGG CACGAAGACCTACACCTGCAACG TAGATCACAAGCCCAGCAACACC CAGGTGGACAAGAGAGTTGGATC C (SEQ ID NO: 378) |
| CH1(118-131) | ASTKGPSVFPLAPC (SEQ ID NO: 379) | GCTAGCACCAAGGGGCCATCCGT CTTCCCCCTGGCGCCCTGC (SEQ ID NO: 380) |
| CH1(118-130) | ASTKGPSVFPLAP (SEQ ID NO: 381) | GCTAGCACCAAGGGGCCATCCGT CTTCCCCCTGGCGCCC (SEQ ID NO: 382) |

The 281VL4-CH1-281 comprises the sequence comprising the CH1 sequence (positions 118 to 215 of the EU index of Kabat) of IgG4 and the BamHI sequence (GGATCC) added to its 3'-terminal were inserted as a linker between the heavy chains (3'-terminal of 281VL4 heavy chain, 5'-terminal of 281 heavy chain).

The gene sequence encoding the heavy chain of 281VL4-CH1-281 was prepared by the following steps.

The linker gene fragment with the NheI sequence added to the 5'-terminal was amplified by carrying out 30 cycles of reaction at 95° C. for 30 seconds, at 55° C. for 30 seconds, and at 68° C. for 30 seconds as one cycle using the 281 heavy chain sequence as a template and 5'-GGGGCTAG-CACCAAGGGGCCA-3' (SEQ ID NO:144) and 5'-GGATCCAACTCTCTTGTCCACCTT-3' (SEQ ID NO:145) as primers and using DNA polymerase (KOD-Plus, manufactured by Toyobo Co. Ltd). A 281 heavy chain gene fragment with the linker gene (15 bases from the 3'-terminal side) added to the 5'-terminal and with the NheI sequence added to the 3'-terminal was amplified by carrying out 30 cycles of reaction at 95° C. for 30 seconds, at 55° C. for 30 seconds, and at 68° C. for 30 seconds using the 281 heavy chain sequence as a template and 5'-AAGAGAGTTG-GATCCCAGGTGCAGCTGCAG-3' (SEQ ID NO:146) and 5'-GGGGCTAGCTGAGGAGACGGTGACCA-3' (SEQ ID NO:147) as primers and using DNA polymerase (KOD-Plus, manufactured by Toyobo Co. Ltd). The thus obtained two gene fragments were linked with Over Extension PCR, and thereby the linker-281 heavy chain gene fragment was prepared. This gene fragment was digested with NheI and then inserted into 281VL4 expression vector which had been dephosphorylated with Alkaline Phosphatase (BAP, manufactured by Takara Bio Inc) after digesting with NheI. Each of 281VL4-CH1-281 heavy chain nucleic acid sequence (SEQ ID NO:148) and 281VL4-CH1-281 heavy chain amino acid sequence (SEQ ID NO:149) is shown in the Sequence Listing.

In order to prepare a multivalent antibody comprising the recognition site for CD28 and the recognition site for CD40 in a row in order from the N-terminal side of the heavy chain, the heavy chain variable region of the anti-CD28 antibody 281VL4 was linked in tandem to the heavy chain variable region of anti-CD40 antibody 281 via the linker (SEQ ID NO:151). Since the same light chain as that of 281 is used for the anti-CD28 antibody, the expression vector comprises one type of light chain sequence. This multivalent antibody was named 281VL4-CH1(118-131)-281.

In 281VL4-CH1(118-131)-281, CH1 sequence of IgG4 (positions 118 to 131 of the EU index of Kabat) was inserted as a linker between the heavy chains (3'-terminal of 281VL4 heavy chain, 5'-terminal of 281 heavy chain).

The gene sequence encoding the heavy chain of 281VL4-CH1(118-131)-281 was prepared by the following steps.

Thirty cycles of reaction at 95° C. for 30 seconds, at 55° C. for 30 seconds, and at 68° C. for 30 seconds as one cycle were carried out using the 281 heavy chain sequence as the template and 5'-GTCTTCCCCCTGGCGCCCTGCCAGGT-GCAGCTGCAGGAGTC-3' (SEQ ID NO:150) and 5'-GGGGCTAGCTGAGGAGACGGTGACCA-3 (SEQ ID NO:147) as primers and using DNA polymerase (KOD-Plus, manufactured by Toyobo Co. Ltd). A 281 heavy chain gene fragment with the linker gene (the 5'-terminal of the linker sequence is the NheI sequence) added to the 5'-terminal and with the NheI sequence added to the 3'-terminal was amplified by carrying out by 35 cycles of reaction at 95° C. for 30 seconds, at 55° C. for 30 seconds, and at 68° C. for 30 seconds as one cycle using this PCR product as a template and 5'-GGGGCTAGCACCAAGGGGCCATCCGTCTTC-CCCCTGGCGCCC-3' (SEQ ID NO:151) and 5'-GGGGCTAGCTGAGGAGACGGTGACCA-3' (SEQ ID NO: 147) as a primer and using DNA polymerase (KOD-Plus, manufactured by Toyobo Co. Ltd). The thus obtained gene fragment was digested with NheI and then inserted into the 281VL4 expression vector which had been dephosphorylated with Alkaline Phosphatase (BAP, manufactured by Takara Bio Inc) after digesting with NheI. Each of 281VL4-CH1(118-131)-281 heavy chain nucleic acid sequence (SEQ ID NO:152) and 281VL4-CH1(118-131)-281 heavy chain amino acid sequence (SEQ ID NO:153) is shown in the Sequence Listing.

In 281VL4-CH1(118-130)-281, CH1 sequence (positions 118 to 130 of the EU index of Kabat) of IgG4 was inserted as a linker between the heavy chains (3'-terminal of 281VL4 heavy chain, 5'-terminal of 281 heavy chain).

The gene sequence encoding the heavy chain of 281VL4-CH1(118-130)-281 was prepared by the following steps.

Thirty cycles of reaction at 95° C. for 30 seconds, at 55° C. for 30 seconds, and at 68° C. for 30 seconds as one cycle were carried out using the 281 heavy chain sequence as a template and 5'-GTCTTCCCCCTGGCGCCCAGGT-GCAGCTGCAGGAGTC-3' (SEQ ID NO:154) and 5'-GGGGCTAGCTGAGGAGACGGTGACCA-3 (SEQ ID NO:147) as primers and using DNA polymerase (KOD-Plus, manufactured by Toyobo Co. Ltd). The 281 heavy chain gene fragment with the linker gene (the 5'-terminal of the linker sequence is the NheI sequence) added to the 5'-terminal and with the NheI sequence added to the 3'-terminal was amplified by carrying out 35 cycles of reaction at 95° C. for 30 seconds, at 55° C. for 30 seconds, and at 68° C. for 30 seconds as one cycle using thus obtained PCR product as a template and 5'-GGGGCTAGCACCAAGGGGCCATC-CGTCTTCCCCCTGGCGCCC-3' (SEQ ID NO:151) and 5'-GGGGCTAGCTGAGGAGACGGTGACCA-3' (SEQ ID NO:147) as primers and using DNA polymerase (KOD-Plus, manufactured by Toyobo Co. Ltd). The thus obtained gene fragment was digested with NheI and then inserted into the 281VL4 expression vector which had been dephosphorylated with Alkaline Phosphatase (BAP, manufactured by Takara Bio Inc) after digesting with NheI. Each of the nucleic acid sequence of 281VL4-CH1(118-130)-281 heavy chain (SEQ ID NO:155) and the amino acid sequence of 281VL4-CH1(118-130)-281 heavy chain (SEQ ID NO:156) is shown in the Sequence Listing.

Example 25

Expression and Purification of Multivalent Antibody

The produced expression vector gene was prepared using QIAGEN Plasmid Maxi Kit (manufactured by Qiagen) and then introduced into nonadherent 293 cells using FreeStyle™ 293 Expression System (Invitrogen by Life Technologies Corporation), and thereby the culture supernatant containing each antibodies was obtained by transient expression. The purified antibody was obtained from the culture supernatant in accordance with the procedure of Example 16. In regard to the density of a purified antibody, the absorbance at 280 nm was measured, and the density of 1 mg/mL antibody was assumed to be 1.40 optimal density for the calculation.

Example 26

Measurement of Antibody Productivity

The antibody content of each culture supernatant was measured to know the productivity of the antibody. The measurement of the antibody content was carried out in the same manner as Example 17. The result is shown in Table 7.

TABLE 7

Productivity of Respective Antibodies

| Name of Multivalent Antibody | Antibody Density in Culture Supernatant | | Amino Acid Number of Linker |
|---|---|---|---|
| | µg/mL | nM | |
| 281 | 11.4 | 78.6 | — |
| 281VL4 | 14.5 | 99.5 | — |
| 281VL4-CH1-281 | 24.3 | 101.5 | 100 |
| 281VL4-CH1(118-131)-281 | 24.8 | 111.9 | 14 |
| 281VL4-CH1(118-130)-281 | 12.9 | 58.3 | 13 |

Example 27

Evaluation of Antibody Stability

The aggregate content rate of the antibody solution was measured in the same manner as Example 18. The result is shown in Table 8.

TABLE 8

Aggregate Containing Amount of Respective Purified Antibody

| Name of Multivalent Antibody | Aggregate Content (%) | Amino Acid Number of Linker |
|---|---|---|
| 281VL4-CH1-281 | 1.5 | 100 |
| 281VL4-CH1(118-131)-281 | 1.4 | 14 |
| 281VL4-CH1(118-130)-281 | 9.2 | 13 |

Example 28

Evaluation of Antigen Binding Property of Antibody

The binding of the produced antibody comprising two (CD40 and CD28) recognition sites for each antigen was measured in the same manner as Example 19. As a result, it was found that all of 281VL4-CH1-281, 281VL4-CH1(118-131)-281 and 281VL4-CH1(118-130)-281 bound to human-CD40-Fc fusion protein and human-CD28-Fc fusion protein.

Example 29

Preparation of Expression Vector of Multivalent Antibody Comprising Antigen Recognition Site for CD28 (281VL4 Origin) at N-Terminal Side, Antigen Recognition Site for CD40 (281 Origin) at C-Terminal Side and Linker in Table 9

In order to produce the multivalent antibody comprising the recognition site for CD28 and the recognition site for CD40 in a row in order from the heavy chain N-terminal side, the heavy chain variable region of anti-CD28 antibody 281VL4 was linked in tandem to the heavy chain variable region of anti-CD40 antibody 281 from the N-terminal side via the linker shown in Table 9. Since the same light chain as that of 281 is used for the anti-CD28 antibody, the expression vector comprises one type of light chain sequence. This multivalent antibody was named 281VL4-CH1(118-131/C131S)-281.

TABLE 9

Linker Structures of Multivalent Antibody

| Name | Linker Amino Acid Sequence | Base Sequence |
|---|---|---|
| CH1 (118-131) | ASTKGPSVFPLAPC (SEQ ID NO: 379) | GCTAGCACCAAGGGGC-CATCC GTCTTCCCCCTGGCGC-CCTGC (SEQ ID NO: 380) |
| CH1 (118-131/C131S) | ASTKGPSVFPLAPS (SEQ ID NO: 383) | GCATCCCCGACCAGC-CCCAAG GTCTTCCCGCTGAGC-CTCTCC (SEQ ID NO: 384) |

In 281VL4-CH1(118-131/C131S)-281, CH1 sequence of IgG1 (positions 118 to 131 of the EU index of Kabat) was inserted as a linker between the heavy chains (3'-terminal of 281VL4 heavy chain, 5'-terminal of 281 heavy chain).

The gene sequences encoding the heavy chains of these antibodies were prepared based on the procedure of the genetic method used in Example 24. Each of 281VL4-CH1(118-131/C131S)-281 heavy chain nucleic acid sequence (SEQ ID NO:157) and 281VL4-CH1(118-131/C131S)281 heavy chain amino acid sequence (SEQ ID NO:158) is shown in the Sequence Listing.

Example 30

Preparation of Expression Vector of Multivalent Antibody Comprising Antigen Recognition Site for CD28 (281VL4 Origin) at N-Terminal Side, Antigen Recognition Site for CD40 (281 Origin) at C-Terminal Side and Linker in Table 10

In order to produce the multivalent antibody comprising the recognition site for CD28 and the recognition site for CD40 in a row in order from the heavy chain N-terminal side, the heavy chain variable region of the anti-CD28 antibody 281VL4 was linked in tandem to the heavy chain variable region of anti-CD40 antibody 281 from the N-terminal side via a linker shown in Table 10. Since the same light chain as that of the 281 is used for the anti-CD28 antibody, the expression vector comprises one type of light chain sequence. These multivalent antibodies were named 281VL4-CH1(118-119+C)-281, 281VL4-CH1(118-120+C)-281, 281VL4-CH1(118-121+C)-281, 281VL4-CH1(118-122+C)-281, 281VL4-CH1(118-123+C)-281, 281VL4-CH1(118-124+C)-281, 281VL4-CH1(118-125+C)-281, 281VL4-CH1(118-126+C)-281, 281VL4-CH1(118-127+C)-281, 281VL4-CH1(118-128+C)-281, and 281VL4-CH1(118-129+C)-281, respectively.

TABLE 10

Linker Structures of Multivalent Antibody

| Name | Linker Amino Acid Sequence | Base Sequence |
|---|---|---|
| GCH1(118-131) | ASTKGPSVFP LAPC (SEQ ID NO: 379) | CTAGCACCAAGGGGCCATCCG TCTTCCCCCTGGCGCCCTGC (SEQ ID NO: 380) |
| CH1(118-119 + C) | ASC (SEQ ID NO: 385) | GCTAGCTGC (SEQ ID NO: 386) |
| CH1(118-120 + C) | ASTC (SEQ ID NO: 387) | GCTAGCACCTGC (SEQ ID NO: 388) |
| CH1(118-121 + C) | ASTKC (SEQ ID NO: 389) | GCTAGCACCAAGTGC (SEQ ID NO: 390) |
| CH1(118-122 + C) | ASTKGC (SEQ ID NO: 391) | GCTAGCACCAAGGGGTGC (SEQ ID NO: 392) |
| CH1(118-123 + C) | ASTKGPC (SEQ ID NO: 393) | GCTAGCACCAAGGGGCCATGC (SEQ ID NO: 394) |
| CH1(118-124 + C) | ASTKGPSC (SEQ ID NO: 395) | GCTAGCACCAAGGGGCCATCC TGC (SEQ ID NO: 396) |
| CH1(118-125 + C) | ASTKGPSVC (SEQ ID NO: 397) | GCTAGCACCAAGGGGCCATCC GTCTGC (SEQ ID NO: 398) |
| CH1(118-126 + C) | ASTKGPSVFC (SEQ ID NO: 399) | GCTAGCACCAAGGGGCCATCC GTCTTCTGC (SEQ ID NO: 400) |
| CH1(118-127 + C) | ASTKGPSVFPC (SEQ ID NO: 401) | GCTAGCACCAAGGGGCCATCC GTCTTCCCTGC (SEQ ID NO: 402) |
| CH1(118-128 + C) | ASTKGPSVFPLC (SEQ ID NO: 403) | GCTAGCACCAAGGGGCCATCC GTCTTCCCCCTGTGC (SEQ ID NO: 404) |
| CH1(118-129 + C) | ASTKGPSVFPLAC (SEQ ID NO: 405) | GCTAGCACCAAGGGGCCATCC GTCTTCCCCCTGGCGTGC (SEQ ID NO: 406) |

In 281VL4-CH1(118-119+C)-281, 281VL4-CH1(118-120+C)-281, 281VL4-CH1(118-121+C)-281, 281VL4-CH1(118-122+C)-281, 281VL4-CH1(118-123+C)-281, 281VL4-CH1(118-124+C)-281, 281VL4-CH1(118-125+C)-281, 281VL4-CH1(118-126+C)-281, 281VL4-CH1(118-127+C)-281, 281VL4-CH1(118-128+C)-281 and 281VL4-CH1(118-129+C)-281, the sequence comprising CH1 sequence (at positions 118 and 119 to 129 of the EU index of Kabat) of IgG4 and TGC (the nucleic acid sequence encoding cysteine when converted to amino acid) at its 3′-terminal was inserted as a linker between the heavy chains (3′-terminal of the 281VL4 heavy chain, 5′-terminal of the 281 heavy chain).

The gene sequences encoding the heavy chains of these antibodies were prepared based on the procedure of the genetic method used in Example 24. Each of the heavy chain nucleic acid sequences and the heavy chain amino acid sequences (SEQ ID NOs:159 to 180) is shown in the Sequence Listing.

Example 31

Preparation of Expression Vector of Multivalent Antibody Comprising Antigen Recognition Site for CD28 (281VL4 Origin) at N-Terminal Side, Antigen Recognition Site for CD40 (281 Origin) at C-Terminal Side and Linker in Table 11

In order to prepare a multivalent antibody comprising the recognition site for CD28 and the recognition site for CD40 in a row in order from the N-terminal side of the heavy chain, the heavy chain variable region of anti-CD28 antibody 281VL4 was linked in tandem to the heavy chain variable region of anti-CD40 antibody 281 from the N-terminal side via a linker shown in Table 11. Since the same light chain as that of the 281 is used for the anti-CD28 antibody, the expression vector comprises one type of light chain sequence. These multivalent antibodies were named 281VL4-CH1(118-131/A118S)-281, 281VL4-CH1(118-131/S119A)-281, 281VL4-CH1(118-131/T120A)-281, 281VL4-CH1(118-131/K121A)-281, 281VL4-CH1(118-131/G122A)-281, 281VL4-CH1(118-131/P123A)-281, 281VL4-CH1(118-131/S124A)-281, 281VL4-CH1(118-131N125A)-281, 281VL4-CH1(118-131/F126A)-281, 281VL4-CH1(118-131/P127A)-281, 281VL4-CH1(118-131/L128A)-281, 281VL4-CH1(118-131/A129S)-281, and 281VL4-CH1(118-131/P130A)-281, respectively.

TABLE 11

Linker Structures of Multivalent Antibody

| Linker Name | Amino Acid Sequence | Base Sequence |
|---|---|---|
| CH1(118-131) | ASTKGPSVFQLAPC (SEQ ID NO: 379) | GCTAGCACCAAGGGGC-CATCC GTCTTCCCCCTGGCGC-CCTGC (SEQ ID NO: 380) |
| CH1 (118-131/A118S) | SSTKGPSVFPLAPC (SEQ ID NO: 407) | TCTAGCACCAAGGGGC-CATCC GTCTTCCCCCTGGCGC-CCTGC (SEQ ID NO: 408) |
| CH1 (118-131/S119A) | AATKGPSVFPLAPC (SEQ ID NO: 409) | GCTGCCACCAAGGGGC-CATCC GTCTTCCCCCTGGCGC-CCTGC (SEQ ID NO: 410) |
| CH1 (118-131/T120A) | ASAKGPSVFPLAPC (SEQ ID NO: 411) | GCTAGCGCCAAGGGGC-CATCC GTCTTCCCCCTGGCGC-CCTGC (SEQ ID NO: 412) |
| CH1 (118-131/K121A) | ASTAGPSVFPLAPC (SEQ ID NO: 413) | GCTAGCACCGCGGGGC-CATCC GTCTTCCCCCTGGCGC-CCTGC (SEQ ID NO: 414) |
| CH1 (118-131/G122A) | ASTKAPSVFPLAPC (SEQ ID NO: 415) | GCTAGCACCAAGGCGC-CATCC GTCTTCCCCCTGGCGC-CCTGC (SEQ ID NO: 416) |
| CH1 (118-131/P123A) | ASTKGASVFPLAPC (SEQ ID NO: 417) | GCTAGCAC-CAAGGGGGCATCC GTCTTCCCCCTGGCGC-CCTGC (SEQ ID NO: 418) |
| CH1 (118-131/S124A) | ASTKGPAVFPLAPC (SEQ ID NO: 419) | GCTAGCACCAAGGGGCCA-GCC GTCTTCCCCCTGGCGC-CCTGC (SEQ ID NO: 420) |
| CH1 (118-131/V125A) | ASTKGPSAFPLAPC (SEQ ID NO: 421) | GCTAGCACCAAGGGGC-CATCC GCCTTCCCCCTGGCGC-CCTGC (SEQ ID NO: 422) |
| CH1 (118-131/F126A) | ASTKGPSVAPLAPC (SEQ ID NO: 423) | GCTAGCACCAAGGGGC-CATCC GTCGCCCCCCTGGCGC-CCTGC (SEQ ID NO: 424) |
| CH1 (118-131/P127A) | ASTKGPSVFALAPC (SEQ ID NO: 425) | GCTAGCACCAAGGGGC-CATCC GTCTTCGCCCTGGCGC-CCTGC (SEQ ID NO: 426) |
| CH1 (118-131/L128A) | ASTKGPSVFPAAPC (SEQ ID NO: 427) | GCTAGCACCAAGGGGC-CATCC GTCTTCCCCGCGGCGC-CCTGC (SEQ ID NO: 428) |
| CH1 (118-131/A129S) | ASTKGPSVFPLSPC (SEQ ID NO: 429) | GCTAGCACCAAGGGGC-CATCC GTCTTCCCCCTGTCGC-CCTGC (SEQ ID NO: 430) |
| CH1 (118-131/P130A) | ASTKGPSVFPLAAC (SEQ ID NO: 431) | GCTAGCACCAAGGGGC-CATCC GTCTTCCCCCTGGCGGC-CTGC (SEQ ID NO: 432) |

In 281VL4-CH1(118-131/A118S)-281, 281VL4-CH1(118-131/S119A)-281, 281VL4-CH1(118-131/T120A)-281, 281VL4-CH1(118-131/K121A)-281, 281VL4-CH1(118-131/G122A)-281, 281VL4-CH1(118-131/P123A)-281, 281VL4-CH1(118-131/S124A)-281, 281VL4-CH1(118-131N125A)-281, 281VL4-CH1(118-131/F126A)-281, 281VL4-CH1(118-131/P127A)-281, 281VL4-CH1(118-131/L128A)-281, 281VL4-CH1(118-131/A129S)-281, and 281VL4-CH1(118-131/P130A)-281, a sequence in which the CH1 (positions 118 to 131 of the EU index of Kabat) of IgG4 was mutated was inserted as a linker between the heavy chains (3′-terminal of the 281VL4 heavy chain, 5′-terminal of the 281 heavy chain). The mutation in each linker is one amino acid. Namely, the amino acid in the CH1 sequence of IgG4 was substituted with alanine. In addition, when alanine originally exists at the position to be mutated, alanine is substituted with cysteine.

The gene sequences encoding the heavy chains of these antibodies were produced based on the procedure of the genetic method used in Example 24. Each of the heavy chain nucleic acid sequences and heavy chain amino acid sequences (SEQ ID NOs:181 to 206) is shown in the Sequence Listing.

Example 32

Preparation of Expression Vector of Multivalent Antibody Comprising Antigen Recognition Site for CD28 (281VL4 Origin) at N-Terminal Side, Antigen Recognition Site for CD40 (281 Origin) at C-Terminal Side and Linker in Table 12

In order to produce the multivalent antibody comprising the recognition site for CD28 and the recognition site for CD40 in a row in order from the heavy chain N-terminal side, the heavy chain variable region of anti-CD28 antibody 281VL4 was linked in tandem from the N-terminal side to the heavy chain variable region of the anti-CD40 antibody 281 via the linker shown in Table 12. Since the same light chain as that of the 281 is used for the anti-CD28 antibody, the expression vector comprises one type of light chain sequence. These multivalent antibodies were named 281VL4-CH1(IGHA)-281, 281VL4-CH1(IGHD(14))-281, 281VL4-CH1(IGHD(15))-281, 281VL4-CH1(IGHE)-281, 281VL4-CH1(IGHGP)-281, and 281VL4-CH1(IGHM)-281, respectively.

TABLE 12

Linker Structures of Multivalent Antibody Linker

| Name | Amino Acid Sequence | Base Sequence |
|---|---|---|
| C111 (118-131) | ASTKGPSVFPLAPC (SEQ ID NO: 379) | GCTAGCACCAAGGGGC-CATCC GTCTTCCCCCTGGCGC-CCTGC (SEQ ID NO: 380) |
| CH1 (IGHA) | ASPTSPKVFPLSLC (SEQ ID NO: 433) | GCATCCCCGACCAGC-CCCAAG GTCTTCCCGCTGAGC-CTCTGC (SEQ ID NO: 434) |
| CH1 (IGHD(14)) | APTKAPDVFPIISC (SEQ ID NO: 435) | GCACCCACCAAGGCTCCG-GAT GTGTTCCCCATCATAT-CATGC (SEQ ID NO: 436) |
| CH1 (IGHD(15)) | APTKAPDVFPIISGC (SEQ ID NO: 437) | GCACCCACCAAGGCTCCG-GAT GTGTTCCCCATCATATCA-GGG TGC (SEQ ID NO: 438) |
| CH1 (IGHE) | ASTQSPSVFPLTRC (SEQ ID NO: 439) | GCCTCCACACAGAGC-CCATCC GTCTTCCCCCTTGAC-CCGCTGC (SEQ ID NO: 440) |
| CH1 (IGHGP) | ASTKGPSVFPLVPC (SEQ ID NO: 441) | GCCTCCACCAAGGGC-CCATCG GTCTTCCCCCTGGTGC-CCTGC (SEQ ID NO: 442) |
| CH1 (IGHM) | GSASAPTLFPLVSC (SEQ ID NO: 443) | GGGAGTGCATCCGC-CCCAACC CTTTTCCCCCTCGTCTC-CTGT (SEQ ID NO: 444) |

In 281VL4-CH1(IGHA)-281, 281VL4-CH1(IGHD(14))-281, 281VL4-CH1(IGHE)-281, 281VL4-CH1(IGHGP)-281, and 281VL4-CH1(IGHM)-281, the CH1 sequence (positions 118 to 131 of the EU index of Kabat) of each subclasses was inserted as a linker between the heavy chains (3'-terminal of the 281VL4 heavy chain, 5'-terminal of the 281 heavy chain). Since the subclass IGHD in which amino acid at position 131 was not cysteine, the amino acid at position 131 was substituted by replacing glycine with cysteine, and for IGHGP, the amino acid at position 131 was substituted by replacing serine with cysteine. In addition, in 281VL4-CH1(IGHD(15))-281, the CH1 sequence (positions 118 to 132) of IGHD was inserted as a linker between the heavy chains.

The gene sequences encoding the heavy chains of these antibodies were produced based on the procedure of the genetic method used in Example 24. Each of the heavy chain nucleic acid sequences and heavy chain amino acid sequences (SEQ ID NOs:207 to 218) is shown in the Sequence Listing.

Example 33

Preparation of Expression Vector of Multivalent Antibody Comprising Antigen Recognition Site for CD28 (281VL4 Origin) at N-Terminal Side, Antigen Recognition Site for CD40 (281 Origin) at C-Terminal Side and Linker in Table 13

In order to produce the multivalent antibody comprising the recognition site for CD28 and the recognition site for CD40 in a row in order from the heavy chain N-terminal side, the heavy chain variable region of anti-CD28 antibody 281VL4 was linked in tandem to the heavy chain variable region of anti-CD40 antibody 281 from the N-terminal side via a linker shown in Table 13. Since the same light chain as that of 281 is used for the anti-CD28 antibody, the expression vector comprises one type of light chain sequence. These multivalent antibodies were named 281VL4-CH1(118-131/A118G)-281, 281VL4-CH1(118-131/S119T)-281, 281VL4-CH1(118-131/P123F)-281, 281VL4-CH1(118-131/V125L)-281, 281VL4-CH1(118-131/V125I)-281, 281VL4-CH1(118-131/F126L)-281, 281VL4-CH1(118-131/F126Y)-281, 281VL4-CH1(118-131/P127G)-281, 281VL4-CH1(118-131/L128V)-281, 281VL4-CH1(118-131/L128I)-281, 281VL4-CH1(118-131/A129I)-281, and 281VL4-CH1(118-131/P130F)-281, respectively.

TABLE 13

Linker Structures of Multivalent Antibody Linker

| Name | Amino Acid Sequence | Base Sequence |
|---|---|---|
| CH1 (118-131) | ASTKGPSVFPLAPC (SEQ ID NO: 379) | GCTAGCACCAAGGGGC-CATCC GTCTTCCCCCTGGCGC-CCTGC (SEQ ID NO: 380) |
| CH1 (118-131/A118G) | GSTKGPSVFPLAPC (SEQ ID NO: 445) | GGCAGCACCAAGGGGC-CATCC GTCTTCCCCCTGGCGC-CCTGC (SEQ ID NO: 446) |

TABLE 13-continued

Linker Structures of Multivalent Antibody Linker

| Name | Amino Acid Sequence | Base Sequence |
|---|---|---|
| CH1 (118-131/S119T) | ATTKGPSVFPLAPC (SEQ ID NO: 447) | GCTACCACCAAGGGGC-CATCC GTCTTCCCCCTGGCGC-CCTGC (SEQ ID NO: 448) |
| CH1 (118-131/P123F) | ASTKGFSVFPLAPC (SEQ ID NO: 449) | CCTAGCACCAAGGGGT-TCTCC GTCTTCCCCCTGGCGC-CCTGC (SEQ ID NO: 450) |
| CH1 (118-131/V125L) | ASTKGPSLFPLAPC (SEQ ID NO: 451) | GCTAGCACCAAGGGGC-CATCC CTGTTCCCCCTGGCGC-CCTGC (SEQ ID NO: 452) |
| CH1 (118-131/V125I) | ASTKGPSIFPLAPC (SEQ ID NO: 453) | GCTAGCACCAAGGGGC-CATCC ATCTTCCCCCTGGCGC-CCTGC (SEQ ID NO: 454) |
| CH1 (118-131/F126L) | ASTKGPSVLPLAPC (SEQ ID NO: 455) | GCTAGCACCAAGGGGC-CATCC GTCCTGCCCCTGGCGC-CCTGC (SEQ ID NO: 456) |
| CH1 (118-131/F126Y) | ASTKGPSVYPLAPC (SEQ ID NO: 457) | GCTAGCACCAAGGGGC-CATCC GTCTACCCCCTGGCGC-CCTGC (SEQ ID NO: 458) |
| CH1 (118-131/P127G) | ASTKGPSVFGLAPC (SEQ ID NO: 459) | GCTAGCACCAAGGGGC-CATCC GTCTTCGGCCTGGCGC-CCTGC (SEQ ID NO: 460) |
| CH1 (118-131/L128V) | ASTKGPSVFPVAPC (SEQ ID NO: 461) | GCTAGCACCAAGGGGC-CATCC GTCTTCCCCGTGGCGC-CCTGC (SEQ ID NO: 462) |
| CH1 (118-131/L128I) | ASTKGPSVFPIAPC (SEQ ID NO: 463) | GCTAGCACCAAGGGGC-CATCC GTCTTCCCCATCGCGC-CCTCG (SEQ ID NO: 464) |
| CH1 (118-131/A129I) | ASTKGPSVFPLIPC (SEQ ID NO: 465) | GCTAGCACCAAGGGGC-CATCC GTCTTCCCCCTGATC-CCCTGC (SEQ ID NO: 466) |
| CH1 (118-131/P130F) | ASTKGPSVFPLAFC (SEQ ID NO: 467) | GCTAGCACCAAGGGGC-CATCC GTCTTCCCCCTGGCGT-TCTGC (SEQ ID NO: 468) |

In 281VL4-CH1(118-131/A118G)-281, 281VL4-CH1(118-131/S119T)-281, 281VL4-CH1(118-131/P123F)-281, 281VL4-CH1(118-131N125L)-281, 281VL4-CH1(118-131/V125I)-281, 281VL4-CH1(118-131/F126L)-281, 281VL4-CH1(118-131/F126Y)-281, 281VL4-CH1(118-131/P127G)-281, 281VL4-CH1(118-131/L128V)-281, 281VL4-CH1(118-131/L128I)-281, 281VL4-CH1(118-131/A129I)-281, and 281VL4-CH1(118-131/P130F)-281, a sequence in which the CH1 (positions 118 to 131 of the EU index of Kabat) of IgG4 was mutated was inserted as a linker between the heavy chains (3'-terminal of the 281VL4 heavy chain, 5'-terminal of the 281 heavy chain). The mutation in each linker is one amino acid. The amino acid in the CH1 sequence of IgG4 was substituted with other amino acids at random.

The gene sequences encoding the heavy chains of these antibodies were prepared based on the procedure of the genetic method used in Example 24. Each of the heavy chain nucleic acid sequences and heavy chain amino acid sequences (SEQ ID NOs:219 to 242) is shown in the Sequence Listing.

Example 34

Expression and Purification of Multivalent Antibody

Each expression vector gene prepared in Examples 29 to 33 was obtained using QIAGEN Plasmid Maxi Kit (manufactured by Qiagen) and then introduced into nonadherent 293 cells using FreeStyle™ 293 Expression System (Invitrogen by Life Technologies Corporation) to obtain culture supernatant containing each antibody by transient expression. The purified antibody was obtained from the culture supernatant in accordance with the procedure of Example 16. In regard to the density of the purified antibody, the absorbance at 280 nm was measured, and the density of the 1 mg/mL antibody was assumed to be 1.40 Optimal Density for the calculation.

Example 35

Evaluation of Antibody Stability

The aggregate content rate of the antibody solution was measured in accordance with the procedure of Example 18. The result is shown in Table 14.

TABLE 14

Aggregate Content of Respective Purified Antibody

| Name of Multivalent Antibody | Aggregate Content (%) | Amino Acid Number of Linker |
|---|---|---|
| 1) Antibody Shown in Example 29 | | |
| 281VL4-CH1(118-131/C131S)-281 | 6.1 | 14 |
| 2) Antibody Shown in Example 30 | | |
| 281VL4-CH1(118-119 + C)-281 | 12.9 | 3 |
| 281VL4-CH1(118-120 + C)-281 | 13.3 | 4 |
| 281VL4-CH1(118-121 + C)-281 | 11.1 | 5 |
| 281VL4-CH1(118-122 + C)-281 | 13.0 | 6 |
| 281VL4-CH1(118-123 + C)-281 | 13.1 | 7 |
| 281VL4-CH1(118-124 + C)-281 | 11.2 | 8 |
| 281VL4-CH1(118-125 + C)-281 | 9.7 | 9 |
| 281VL4-CH1(118-126 + C)-281 | 12.2 | 10 |
| 281VL4-CH1(118-127 + C)-281 | 10.5 | 11 |
| 281VL4-CH1(118-128 + C)-281 | 9.7 | 12 |
| 281VL4-CH1(118-129 + C)-281 | 9.2 | 13 |
| 3) Antibody Shown in Example 31 | | |

| Multivalent Antibody Name | Aggregate Content (%) | Amino Acid Number of Linker |
|---|---|---|
| 281VL4-CH1(118-131/A118S)-281 | 3.7 | 14 |
| 281VL4-CH1(118-131/S119A)-281 | 3.6 | 14 |
| 281VL4-CH1(118-131/T120A)-281 | 4.9 | 14 |
| 281VL4-CH1(118-131/K121A)-281 | 3.3 | 14 |
| 281VL4-CH1(118-131/G122A)-281 | 4.7 | 14 |

TABLE 14-continued

Aggregate Content of Respective Purified Antibody

| | | |
|---|---|---|
| 281VL4-CH1(118-131/P123A)-281 | 2.9 | 14 |
| 281VL4-CH1(118-131/S124A)-281 | 4.7 | 14 |
| 281VL4-CH1(118-131/V125A)-281 | 3.4 | 14 |
| 281VL4-CH1(118-131/F126A)-281 | 4.9 | 14 |
| 281VL4-CH1(118-131/P127A)-281 | 5.3 | 14 |
| 281VL4-CH1(118-131/L128A)-281 | 5.2 | 14 |
| 281VL4-CH1(118-131/A129S)-281 | 4.3 | 14 |
| 281VL4-CH1(118-131/P130A)-281 | 4.3 | 14 |

| Name of Multivalent Antibody | Aggregate Content (%) | Amino Acid Number of Linker |
|---|---|---|
| 4) Antibody Shown in Example 32 | | |
| 281VL4-CH1(IGHA)-281 | 2.6 | 14 |
| 281VL4-CH1(IGHD(14))-281 | 3.9 | 14 |
| 281VL4-CH1(IGHD(15))-281 | 3.9 | 15 |
| 281VL4-CH1(IGHE)-281 | 3.6 | 14 |
| 281VL4-CH1(IGHGP)-281 | 3.3 | 14 |
| 281VL4-CH1(IGHM)-281 | 2.4 | 14 |
| 5) Antibody Shown in Example 33 | | |
| 281VL4-CH1(118-131/A118G)-281 | 3.2 | 14 |
| 281VL4-CH1(118-131/S119T)-281 | 2.7 | 14 |
| 281VL4-CH1(118-131/P123F)-281 | 3.5 | 14 |
| 281VL4-CH1(118-131/V125L)-281 | 2.6 | 14 |
| 281VL4-CH1(118-131/V125I)-281 | 2.1 | 14 |
| 281VL4-CH1(118-131/F126L)-281 | 3.6 | 14 |
| 281VL4-CH1(118-131/F126Y)-281 | 1.7 | 14 |
| 281VL4-CH1(118-131/P127G)-281 | 2.7 | 14 |
| 281VL4-CH1(118-131/L128V)-281 | 2.3 | 14 |
| 281VL4-CH1(118-131/L128I)-281 | 2.7 | 14 |

TABLE 14-continued

Aggregate Content of Respective Purified Antibody

| | | |
|---|---|---|
| 281VL4-CH1(118-131/A129I)-281 | 1.6 | 14 |
| 281VL4-CH1(118-131/P130F)-281 | 4.2 | 14 |

Example 36

Structure of Multivalent Antibody comprising Antigen Recognition Site for CD28 (281VL4 Origin) at N-terminal Side, Antigen Recognition Site for CD40 (281 Origin) at C-terminal Side and Sequence in CH1 Region of Each Subclass of Human Ig as Linker In order to prepare a multivalent antibody comprising the recognition site for CD28, the recognition site for CD40 in a row in order from the N-terminal side of the heavy chain, the heavy chain variable region of anti-CD28 antibody 281VL4 was linked in tandem to the heavy chain variable region of the anti-CD40 antibody 281 from the N-terminal side via a linker shown in Table 1. As a linker of the multivalent antibody in each Example, the sequence in the CH1 region of each subclass of human Ig and GS (GGATCC) of BamHI sequence added to its 3'-terminal were inserted. These multivalent antibodies were named 281VL4-A1 (118-143)GS-281, 281VL4-A2(118-143)GS-281, 281VL4-E(118-143)GS-281, 281VL4-G1(118-143)GS-281, 281VL4-G2(118-143)GS-281, 281VL4-G3(118-143)GS-281, 281VL4-HGP(118-143)GS-281, 281VL4-D (118-143)GS-281, and 281VL4-M(118-143)GS-281, respectively. FIG. 15 shows the structures of the produced multivalent antibodies.

TABLE 15

Structures of Multivalent Antibody

| Mulitvalent Antibody Name | Antibody Name Used at N-terminal Side | Antibody Name Used at C-terminal Side | Base Sequence of Linker (SEQ ID NO:) Amino Acid Sequence of Linker (SEQ ID NO:) | EU index of Kabat | Linker Amino Acid Number |
|---|---|---|---|---|---|
| 281VL4-A1 (118-143) GS-281 | 281VL4 | 281 | (SEQ ID NO: 243) GCTAGCCCGACCAGCCCCAAGGTCTTCC CGCTGAGCCTCTGCAGCACCCAGCCAGA TGGGAACGTGGTCATCGCCGGATCC (SEQ ID NO: 244) ASPTSPKVFPLSLCSTQPDGNVVIAGS | 118 to 143 | 27 |
| 281VL4-A2 (118-143) GS-281 | 281VL4 | 281 | (SEQ ID NO: 245) GCTAGCCCGACCAGCCCCAAGGTCTTCC CGCTGAGCCTCTGCAGCACCCCCCAAGA TGGGAACGTGGTCGTCGCAGGATCC (SEQ ID NO: 246) ASPTSPKVFPLSLCSTPQDGNVVVAGS | 118 to 143 | 27 |
| 281VL4-D (118-143) GS-281 | 281VL4 | 281 | (SEQ ID NO: 247) GCACCCACCAAGGCTCCGGATGTGTTCC CCATCATATCAGGGTGCAGACACCCAAA GGATAACAGCCCTGTGGTCCTGGCAGGA TCC (SEQ ID NO: 248) APTKAPDVFPIISGCRHPKDNSPVVLAGS | 118 to 143 | 29 |
| 281VL4-E (118-143) GS-281 | 281VL4 | 281 | (SEQ ID NO: 249) GCTAGCACACAGAGCCCATCCGTCTTCC CCTTGACCCGCTGCTGCAAAAACATTCC CTCCAATGCCACCTCCGTGACTCTGGGC GGATCC (SEQ ID NO: 250) ASTQSPSVFPLTRCCKNIPSNATSVTLGGS | 118 to 143 | 30 |

TABLE 15-continued

Structures of Multivalent Antibody

| Mulitvalent Antibody Name | Antibody Name Used at N-terminal Side | Antibody Name Used at C-terminal Side | Base Sequence of Linker (SEQ ID NO:) Amino Acid Sequence of Linker (SEQ ID NO:) | EU index of Kabat | Linker Amino Acid Number |
|---|---|---|---|---|---|
| 281VL4-G1 (118-143) GS-281 | 281VL4 | 281 | (SEQ ID NO: 251) GCTAGCACCAAGGGCCCATCGGTCTTCC CCCTGGCACCCTGCTCCAAGAGCACCTC TGGGGGCACAGCGGCCCTGGGCGGATCC (SEQ ID NO: 252) ASTKGPSVFPLAPCSKSTSGGTAALGGS | 118 to 143 | 28 |
| 281VL4-G2 (118-143) GS-281 | 281VL4 | 281 | (SEQ ID NO: 253) GCTAGCACCAAGGGCCCATCGGTCTTCC CCCTGGCGCCCTGCTCCAGGAGCACCTC CGAGAGCACAGCCGCCCTGGGCGGATCC (SEQ ID NO: 254) ASTKGPSVFPLAPCSRSTSESTAALGGS | 118 to 143 | 28 |
| 281VL4-G3 (118-143) GS-281 | 281VL4 | 281 | (SEQ ID NO: 255) GCTAGCACCAAGGGCCCATCGGTCTTCC CCCTGGCGCCCTGCTCCAGGAGCACCTC TGGGGGCACAGCGGCCCTGGGCGGATCC (SEQ ID NO: 256) ASTKGPSVFPLAPCSRSTSGGTAALGGS | 118 to 143 | 28 |
| 281VL4-HGP (118-143) GS-281 | 281VL4 | 281 | (SEQ ID NO: 257) GCTAGCACCAAGGGCCCATCGGTCTTCC CCCTGGTGCCCTGCTCCAGGAGCGTCTC TGAGGGCACAGCGGCCCTGGGCGGATCC (SEQ ID NO: 258) ASTKGPSVFPLVPCSRSVSEGTAALGGS | 118 to 143 | 28 |
| 281VL4-M (118-143) GS-281 | 281VL4 | 281 | (SEQ ID NO: 259) GGGAGTGCATCCGCCCCAACCCTTTTCC CCCTCGTCTCCTGTGAGAATTCCCCGTCG GATACGAGCAGCGTGGCCGTTGGCGGAT CC (SEQ ID NO: 260) GSASAPTLFPLVSCENSPSDTSSVAVGGS | 118 to 143 | 29 |

Example 37

Preparation of Multivalent Antibody Expression Vector Comprising Antigen Recognition Site for CD28 (281VL4 Origin) at N-Terminal Side, Antigen Recognition Site for CD40 (281 Origin) at C-Terminal Side and Linker Represented by SEQ ID NO:244, 246, 250, 252, 254, 256, or 258

In order to produce a multivalent antibody comprising the recognition site for CD28 and the recognition site for CD40 in order from the N-terminal side of the heavy chain, the heavy chain variable region of the anti-CD28 antibody 281VL4 was linked in tandem to the heavy chain variable region of the anti-CD40 antibody 281 from the N-terminal side via a linker (SEQ ID NO:244, 246, 250, 252, 254, 256, or 258). Since the same light chain is used for both the anti-281 antibody and the anti-CD28 antibody, the expression vector comprises one type of light chain sequence.

The gene sequences encoding the heavy chains of these antibodies were prepared based on the procedure of the genetic method used in Example 24.

Each of 281VL4-A1(118-143)GS-281 heavy chain nucleic acid sequence (SEQ ID NO:261), 281VL4-A1(118-143)GS-281 heavy chain amino acid sequence (SEQ ID NO:262), 281VL4-A2(118-143)GS-281 heavy chain nucleic acid sequence (SEQ ID NO:263), 281VL4-A2(118-143)GS-281 heavy chain amino acid sequence (SEQ ID NO:264), 281VL4-E(118-143)GS-281 heavy chain nucleic acid sequence (SEQ ID NO:265), 281VL4-E(118-143)GS-281 heavy chain amino acid sequence (SEQ ID NO:266), 281VL4-G1(118-143)GS-281 heavy chain nucleic acid sequence (SEQ ID NO:267), 281VL4-G1(118-143)GS-281 heavy chain amino acid sequence (SEQ ID NO:268), 281VL4-G2(118-143)GS-281 heavy chain nucleic acid sequence (SEQ ID NO:269), 281VL4-G2(118-143)GS-281 heavy chain amino acid sequence (SEQ ID NO:270), 281VL4-G3(118-143)GS-281 heavy chain nucleic acid sequence (SEQ ID NO:271), 281VL4-G3(118-143)GS-281 heavy chain amino acid sequence (SEQ ID NO:272), 281VL4-HGP(118-143)GS-281 heavy chain nucleic acid sequence (SEQ ID NO:273), and 281VL4-HGP(118-143)GS-281 heavy chain amino acid sequence (SEQ ID NO:274) is shown in the Sequence Listing.

Example 38

Preparation of Multivalent Antibody Expression Vector Comprising Antigen Recognition Site for CD28 (281VL4 Origin) at N-Terminal Side, Antigen Recognition Site for CD40 (281 Origin) at C-Terminal Side and Linker Represented by SEQ ID NO:248 or 260

In order to produce the multivalent antibody comprising the recognition site for CD28 and the recognition site for CD40 in a row in order from the heavy chain N-terminal side, the heavy chain variable region of the anti-CD28 antibody 281VL4 was linked in tandem to the heavy chain variable region of the anti-CD40 antibody 281 from the N-terminal side via a linker (SEQ ID NO:248 or 260). Since the same light chain is used for both the anti-281 antibody and the anti-CD28 antibody, the expression vector comprises one type of light chain sequence.

The gene sequence encoding the heavy chain of 281VL4-linker (SEQ ID NO:248 and 260)-281 was prepared by the following steps.

PCR of 30 cycles of reaction at 95° C. for 30 seconds, at 55° C. for 30 seconds, and at 68° C. for 30 minutes as one cycle was carried out using the 281 heavy chain as a template and NheI CD40 Hc L 5'-CTAGCTAGCTGAGGA-GACGGTGACCAGGGTTCCCTGGCCCCAGGGGTGG-3' (SEQ ID NO:275) as the L primer and IgD-CH1-CD40 U 5'-GCCCTGTGGTCCTGGCAggatccCAGGTGCAGCT-GCAGGAGTCGGGCCC-3' (SEQ ID NO:276) and IgM-CH1-CD40 U 5'-ACGAGCAGCGTGGCCGTTGGCggatc-cCAGGTGCAGCTGCAGGAGTCG-3' (SEQ ID NO:277) as the U primer, and using DNA polymerase (KOD-Plus, manufactured by Toyobo Co. Ltd). Furthermore, PCR of 30 cycles of reaction at 95° C. for 30 seconds, at 55° C. for 30 seconds, and at 68° C. for 30 seconds as one cycle was carried out using the obtained PCR product as a template and NheI CD40 Hc L 5'-CTAGCTAGCTGAGGAGACGGT-GACCAGGGTTCCCTGGCCCCAGGGGTGG-3' (SEQ ID NO:275) as the L primer and IgD-CH1-2U 5'-CATATCA-GGGTGCAGACACCCAAAGGATAACAGCCCTGTG-GTCCTGGCA-3' (SEQ ID NO:278) and IgM-CH1-2 U 5'-CTCGTCTCCTGTGAGAATTCCCCGTCGGATAC-GAGCAGCGTGGCCGTTG-3'(SEQ ID NO:279) as the U primer, and using DNA polymerase (KOD-Plus, manufactured by Toyobo Co. Ltd). Moreover, PCR of 30 cycles of reaction at 95° C. for 30 seconds, at 55° C. for 30 seconds, and at 68° C. for 30 seconds as one cycles was carried out using the obtained PCR product as a template and NheI CD40 Hc L 5'-CTAGCTAGCTGAGGAGACGGTGACCA-GGGTTCCCTGGCCCCAGGGGTGG-3'(SEQ ID NO:275) as the L primer and IgD-CH1U 5'-GCACCCAC-CAAGGCTCCGGATGTGTTCCCCATCATATCAGGGT-GCAGAC-3'(SEQ ID NO:280) and IgMCH1U 5'-GGGAGTGCATCCGCCCCAACCCTTTTC-CCCCTCGTCTCCTGTGAGAATT-3' (SEQ ID NO:281) as the U primer, and using DNA polymerase (KOD-Plus, manufactured by Toyobo Co. Ltd), and thereby the linker-281 heavy chain-NheI gene fragment having the NheI sequence at the 3'-terminal was prepared. On the other hand, PCR of 30 cycles of reaction at 95° C. for 30 seconds, at 55° C. for 30 seconds, and at 68° C. for 30 seconds as one cycle was carried out using 281VL4 heavy chain sequence as a template and 5'-GGGGTCGACACCATGAAGCACCT-GTGGTTCTTCCTCCTGCTGGTGGCGG-3' (SEQ ID NO:138) as the U primer and CD28-IgD L 5'-CATCCG-GAGCCTTGGTGGGTGCTGAGGAGACGGTGACCAT-TGTCCCTTG-3' (SEQ ID NO:282) and CD28-IgM L 5'-GGGTTGGGGCGGATGCACTCCCTGAGGAGACG-GTGACCATTGTCCCTTG-3' (SEQ ID NO:283) as the L primer, and using DNA polymerase (KOD-Plus, manufactured by Toyobo Co. Ltd) to prepare SalI-281VL4-linker gene fragment comprising the SalI sequence at the 5'-terminal was prepared. The SalI-281VL4-linker gene fragment and the linker-281-heavy chain-NheI gene fragment were linked with Over Extension PCR, and PCR of 30 cycles of reaction at 95° C. for 30 seconds, at 55° C. for 30 seconds, and at 68° C. for 30 seconds as one cycle was carried out using 5'-GGGGTCGACACCATGAAGCACCTGTGGT-TCTTCCTCCTGCTGGTGGCGG-3'(SEQ ID NO:138) and NheI CD40 Hc L 5'-CTAGCTAGCTGAGGAGACGGT-GACCAGGGTTCCCTGGCCCCAGGGGTGG-3' (SEQ ID NO:275) and using DNA polymerase (KOD-Plus, manufactured by Toyobo Co. Ltd) to prepare SalI-281VL4-linker-281-NheI gene fragment comprising the SalI sequence at the 5'-terminal and the NheI sequence at the 3'-terminal. This gene fragment was digested with SalI and NheI and inserted into the 281VL4 expression vector digested with SalI and NheI. Each of the 281VL4-D(118-143)GS-281 heavy chain nucleic acid sequence (SEQ ID NO:284), the 281VL4-D (118-143)GS-281 heavy chain amino acid sequence (SEQ ID NO:285), the 281VL4-M(118-143)GS-281 heavy chain nucleic acid sequence (SEQ ID NO:286), and the 281VL4-M(118-143)GS-281 heavy chain amino acid sequence (SEQ ID NO:287) is shown in the Sequence Listing.

Example 39

Expression and Purification of Multivalent Antibody comprising Antigen Recognition Site for CD28 (281VL4 Origin) at N-terminal Side, Antigen Recognition Site for CD40 (281 Origin) at C-terminal Side and Linker represented by any one of SEQ IDs NO:244 to 260

The prepared expression vector gene was obtained using QIAGEN Plasmid Maxi Kit (manufactured by Qiagen) and introduced into nonadherent 293 cells using FreeStyle™ 293 Expression System (Invitrogen by Life Technologies Corporation) to obtain culture supernatant containing each antibody by transient expression. The purified antibody was obtained from this culture supernatant in accordance with the procedure of Example 16. In regard to the density of the purified antibody, the absorbance at 280 nm was measured, and the density of the 1 mg/mL antibody was assumed to be 1.40 optimal density for the calculation.

Example 40

Measurement of Productivity of Multivalent Antibody comprising Antigen Recognition Site for CD28 (281VL4 Origin) at N-terminal Side, Antigen Recognition Site for CD40 (281 Origin) at C-terminal Side and Linker represented by any one of SEQ ID NOs:244 to 260

The antibody containing amount in the respective culture supernatants was measured to know the productivity of the antibody. The antibody content was measured in accordance with the procedure of Example 17. The result is shown in Table 16.

TABLE 16

Productivity of Each Antibody

| Name of Multivalent Antibody | Antibody Density in Culture Supernatant (µg/mL) | Number of Amino Acid in Linker |
|---|---|---|
| 281VL4-A1(118-143)GS-281 | 30.43 | 27 |
| 281VL4-A2(118-143)GS-281 | 30.37 | 27 |
| 281VL4-D(118-143)GS-281 | 34.81 | 29 |
| 281VL4-E(118-143)GS-281 | 32.40 | 30 |
| 281VL4-G1(118-143)GS-281 | 29.31 | 28 |
| 281VL4-G2(118-143)GS-281 | 28.13 | 28 |
| 281VL4-G3(118-143)GS-281 | 29.77 | 28 |
| 281VL4-HGP(118-143)GS-281 | 26.45 | 28 |
| 281VL4-M(118-144)GS-281 | 42.21 | 29 |

Example 41

Evaluation of Stability of Multivalent Antibody comprising Antigen Recognition Site for CD28 (281VL4 Origin) at N-terminal Side, Antigen Recognition Site for CD40 (281 Origin) at C-terminal Side and Linker represented by any one of SEQ ID NOs:244 to 260

The aggregate containing rate of the antibody solution was measured by the steps in Example 18. The result is shown in Table 17.

TABLE 17

Aggregate Content of Respective Purified Antibody

| Name of Multivalent Antibody | Aggregate Content (%) | Amino Acid Number of Linker |
|---|---|---|
| 281VL4-A1(118-143)GS-281 | 2.477 | 27 |
| 281VL4-A2(118-143)GS-281 | 2.831 | 27 |
| 281VL4-D(118-143)GS-281 | 2.562 | 29 |
| 281VL4-E(118-143)GS-281 | 2.565 | 30 |
| 281VL4-G1(118-143)GS-281 | 1.566 | 28 |
| 281VL4-G2(118-143)GS-281 | 2.352 | 28 |
| 281VL4-G3(118-143)GS-281 | 2.207 | 28 |
| 281VL4-HGP(118-143)GS-281 | 3.542 | 28 |
| 281VL4-M(118-143)GS-281 | 3.416 | 29 |

Example 42

Structure of Multivalent Antibody comprising Antigen Recognition Site for CD28 (281VL4 Origin) at N-terminal Side, Antigen Recognition Site for CD40 (281 Origin) at C-terminal Side and Sequence (SEQ ID NO:254, 289, 291, 293, 295, 297, 299, 301, 303, 305, 307, 309, or 311) in CH1 Region of IgG2 as a Linker In order to prepare a multivalent antibody comprising the recognition site for CD28 and the recognition site for CD40 in a row in order from the N-terminal side of the heavy chain, the amino acid of the CH1 sequence of the human IgG2 (positions 118 to 143 of the EU index of Kabat) shown in Table 6 was deleted one by one from C-terminal side (positions 118 to 131 of the EU index of Kabat). To each obtained sequence, the BamHI sequence, GS (GGATCC), was added at the 3'-terminal to be a linker. The obtained linkers were represented by SEQ ID NOs:254, 289, 291, 293, 295, 297, 299, 301, 303, 305, 307, 309 and 311, respectively. The heavy chain variable region of anti-CD28 antibody 281VL4 was linked in tandem to the heavy chain variable region of anti-CD40 antibody 281 from the N-terminal side via each linker.

These multivalent antibodies were named 281VL4-G2 (118-143)GS-281, 281VL4-G2(118-142)GS-281, 281VL4-G2(118-141)GS-281, 281VL4-G2(118-140)GS-281, 281VL4-G2(118-139)GS-281, 281VL4-G2(118-138)GS-281, 281VL4-G2(118-137)GS-281, 281VL4-G2(118-136)GS-281, 281VL4-G2(118-135)GS-281, 281VL4-G2(118-134)GS-281, 281VL4-G2(118-133)GS-281, 281VL4-G2(118-132)GS-281, and 281VL4-G2(118-131)GS-281, respectively. In addition, 281VL4-G2(118-143)GS-281 was shown in Example 36. Moreover, as a multivalent antibody using positions 118-131 of the EU index of Kabat as a linker, 281VL4-CH1(118-131)-281 shown in Example 24 was used.

Table 18 shows the structures of the produced multivalent antibodies.

TABLE 18

Structures of Multivalent Antibody

| Mulitvalent Antibody Name | Antibody Name Used at N-terminal Side | Antibody Name Used at C-terminal Side | Base Sequence of Linker (SEQ ID NO:) Amino Acid Sequence of Linker (SEQ ID NO:) | EU index of Kabat | Linker Amino Acid Number |
|---|---|---|---|---|---|
| 281VL4-G2 (118-143) GS-281 | 281VL4 | 281 | (SEQ ID NO: 253) GCTAGCACCAAGGGCCCATCGGTCTTCCCC CTGGCGCCCTGCTCCAGGAGCACCTCCGA GAGCACAGCCGCCCTGGGCGGATCC (SEQ ID NO: 254) ASTKGPSVFPLAPCSRSTSESTAALGGS | 118 to 143 | 28 |
| 281VL4-G2 (118-142) GS-281 | 281VL4 | 281 | (SEQ ID NO: 288) GCTAGCACCAAGGGCCCATCGGTCTTCCCC CTGGCGCCCTGCTCCAGGAGCACCTCCGA GAGCACAGCCGCCCTGGGATCC (SEQ ID NO: 289) ASTKGPSVFPLAPCSRSTSESTAALGS | 118 to 142 | 27 |
| 281VL4-G2 (118-141) GS-281 | 281VL4 | 281 | (SEQ ID NO: 290) GCTAGCACCAAGGGCCCATCGGTCTTCCCC CTGGCGCCCTGCTCCAGGAGCACCTCCGA GAGCACAGCCGCCGGATCC (SEQ ID NO: 291) ASTKGPSVFPLAPCSRSTSESTAAGS | 118 to 141 | 26 |
| 281VL4-G2(118-140)GS-281 | 281VL4 | 281 | (SEQ ID NO: 292) GCTAGCACCAAGGGCCCATCGGTCTTCCCC CTGGCGCCCTGCTCCAGGAGCACCTCCGA GAGCACAGCCGGATCC (SEQ ID NO: 293) ASTKGPSVFPLAPCSRSTSESTAGS | 118 to 140 | 25 |
| 281VL4-G2(118-139)GS-281 | 281VL4 | 281 | (SEQ ID NO: 294) GCTAGCACCAAGGGCCCATCGGTCTTCCCC CTGGCGCCCTGCTCCAGGAGCACCTCCGA GAGCACAGGATCC (SEQ ID NO: 295) ASTKGPSVFPLAPCSRSTSESTGS | 118 to 139 | 24 |

TABLE 18-continued

Structures of Multivalent Antibody

| Mulitvalent Antibody Name | Antibody Name Used at N-terminal Side | Antibody Name Used at C-terminal Side | Base Sequence of Linker (SEQ ID NO:) Amino Acid Sequence of Linker (SEQ ID NO:) | EU index of Kabat | Linker Amino Acid Number |
|---|---|---|---|---|---|
| 281VL4-G2(118-138)GS-281 | 281VL4 | 281 | (SEQ ID NO: 296) GCTAGCACCAAGGGCCCATCGGTCTTCCCC CTGGCGCCCTGCTCCAGGAGCACCTCCGA GAGCGGATCC (SEQ ID NO: 297) ASTKGPSVFPLAPCSRSTSESGS | 118 to 138 | 23 |
| 281VL4-G2(118-137)GS-281 | 281VL4 | 281 | (SEQ ID NO: 298) GCTAGCACCAAGGGCCCATCGGTCTTCCCC CTGGCGCCCTGCTCCAGGAGCACCTCCGA GGGATCC (SEQ ID NO: 299) ASTKGPSVFPLAPCSRSTSEGS | 118 to 137 | 22 |
| 281VL4-G2(118 136)GS-281 | 281VL4 | 281 | (SEQ ID NO:300) GCTAGCACCAAGGGCCCATCGGTCTTCCCC CTGGCGCCCTGCTCCAGGAGCACCTCCGG ATCC (SEQ ID NO: 301) ASTKGPSVFPLAPCSRSTSGS | 118 to 136 | 21 |
| 281VL4-G2(118 - 135)GS-281 | 281VL4 | 281 | (SEQ ID NO: 302) GCTAGCACCAAGGGCCCATCGGTCTTCCCC CTGGCGCCCTGCTCCAGGAGCACCGGATC C (SEQ ID NO: 303) ASTKGPSVFPLAPCSRSTGS | 118 to 135 | 20 |
| 281VL4-G2(118-134)GS-281 | 281VL4 | 281 | (SEQ ID NO: 304) GCTAGCACCAAGGGCCCATCGGTCTTCCCC CTGGCGCCCTGCTCCAGGAGCGGATCC (SEQ ID NO: 305) ASTKGPSVFPLAPCSRSGS | 118 to 134 | 19 |
| 281VL4-G2(118-133)GS-281 | 281VL4 | 281 | (SEQ ID NO: 306) GCTAGCACCAAGGGCCCATCGGTCTTCCCC CTGGCGCCCTGCTCCAGGGGATCC (SEQ ID NO: 307) ASTKGPSVFPLAPCSRGS | 118 to 133 | 18 |
| 281VL4-G2(118-132)GS-281 | 281VL4 | 281 | (SEQ ID NO: 308) GCTAGCACCAAGGGCCCATCGGTCTTCCCC CTGGCGCCCTGCTCCGGATCC (SEQ ID NO:309) ASTKGPSVFPLAPCSGS | 118 to 132 | 17 |
| 281VL4-G2(118-131)GS-281 | 281VL4 | 281 | (SEQ ID NO: 310) GCTAGCACCAAGGGCCCATCGGTCTTCCCC CTGGCGCCCTGC (SEQ ID NO: 311) ASTKGPSVFPLAPC | 118 to 131 | 14 |

Example 43

Preparation of Multivalent Antibody Expression Vector Comprising Antigen Recognition Site for CD28 (281VL4 Origin) at N-Terminal Side, Antigen Recognition Site for CD40 (281 Origin) at C-Terminal Side and Linker Represented by SEQ ID NO:289, 291, 293, 295, 297, 299, 301, 303, 305, 307, or 309

In order to produce a multivalent antibody comprising the recognition site for CD28 and the recognition site for CD40 in order from the heavy chain N-terminal side, the heavy chain variable region of anti-CD28 antibody 281VL4 was linked in tandem from the N-terminal side to the heavy chain variable region of anti-CD40 antibody 281 via a linker (SEQ ID NO:289, 291, 293, 295, 297, 299, 301, 303, 305, 307, or 309). Since the same light chain is used for both the anti-281 antibody and the anti-CD28 antibody, the expression vector comprises one type of light chain sequence. The gene sequence encoding the heavy chains of these antibodies was produced based on the procedure of the genetic method used in Example 24.

Each of 281VL4-G2(118-142)GS-281 heavy chain nucleic acid sequence (SEQ ID NO:312), 281VL4-G2(118-142)GS-281 heavy chain amino acid sequence (SEQ ID NO:313), 281VL4-G2(118-141)GS-281 heavy chain nucleic acid sequence (SEQ ID NO:314), 281VL4-G2(118-141)GS-281 heavy chain amino acid sequence (SEQ ID NO:315), 281VL4-G2(118-140)GS-281 heavy chain nucleic acid sequence (SEQ ID NO:316), 281VL4-G2(118-140)GS-281 heavy chain amino acid sequence (SEQ ID NO:317), 281VL4-G2(118-139)GS-281 heavy chain nucleic acid sequence (SEQ ID NO:318), 281VL4-G2(118-139)GS-281 heavy chain amino acid sequence (SEQ ID NO:319), 281VL4-G2(118-138)GS-281 heavy chain nucleic acid sequence (SEQ ID NO:320), 281VL4-G2(118-138)GS-281 heavy chain amino acid sequence (SEQ ID NO:321), 281VL4-G2(118-137)GS-281 heavy chain nucleic acid sequence (SEQ ID NO:322), 281VL4-G2(118-137)GS-281 heavy chain amino acid sequence (SEQ ID NO:323), 281VL4-G2(118-136)GS-281 heavy chain nucleic acid sequence (SEQ ID NO:324), 281VL4-G2(118-136)GS-281 heavy chain amino acid sequence (SEQ ID NO:325), 281VL4-G2(118-135)GS-281 heavy chain nucleic acid sequence (SEQ ID NO:326), 281VL4-G2(118-135)GS-281 heavy chain amino acid sequence (SEQ ID NO:327), 281VL4-G2(118-134)GS-281 heavy chain nucleic acid sequence (SEQ ID NO:328), 281VL4-G2(118-134)GS-281 heavy chain amino acid sequence (SEQ ID NO:329), 281VL4-G2(118-133)GS-281 heavy chain nucleic acid sequence (SEQ ID NO:330), 281VL4-G2(118-133)GS-281 heavy chain amino acid sequence (SEQ ID NO:331), 281VL4-G2(118-132)GS-281 heavy chain nucleic acid sequence (SEQ ID NO:332) and 281VL4-G2(118-132)GS-281 heavy chain amino acid sequence (SEQ ID NO:333) is shown in the Sequence Listing.

Example 44

Expression and Purification of Multivalent Antibody

The produced expression vector gene was obtained using QIAGEN Plasmid Maxi Kit (manufactured by Qiagen) and introduced into nonadherent 293 cells using FreeStyle™ 293 Expression System (Invitrogen by Life Technologies Corporation) to obtain culture supernatant containing each antibody was obtained by transient expression. The purified antibody was obtained from the culture supernatant in accordance with the procedure in Example 16. In regard to the density of the purified antibody, the absorbance at 280 nm was measured, and the density of the 1 mg/mL antibody was assumed to be 1.40 optimal density for the calculation.

Example 45

Measurement of Antibody Productivity

The antibody containing amount in the respective culture supernatant was measured to know the productivity of the antibody. The measurement of the antibody content was carried out in accordance with the procedure of Example 17. The result is shown in Table 19.

TABLE 19

Productivity of Respective Antibodies

| Name of Multivalent Antibody | Antibody Density in Culture Supernatant (μg/mL) | Number of Linker Amino Acid |
|---|---|---|
| 281VL4-G2(118-143)GS-281 | 30.70 | 28 |
| 281VL4-G2(118-142)GS-281 | 33.68 | 27 |
| 281VL4-G2(118-141)GS-281 | 35.77 | 26 |
| 281VL4-G2(118-140)GS-281 | 35.95 | 25 |
| 281VL4-G2(118-139)GS-281 | 33.31 | 24 |
| 281VL4-G2(118-138)GS-281 | 32.72 | 23 |
| 281VL4-G2(118-137)GS-281 | 31.69 | 22 |

TABLE 19-continued

Productivity of Respective Antibodies

| Name of Multivalent Antibody | Antibody Density in Culture Supernatant (μg/mL) | Number of Linker Amino Acid |
|---|---|---|
| 281VL4-G2(118-136)GS-281 | 1.28 | 21 |
| 281VL4-G2(118-135)GS-281 | 28.09 | 20 |
| 281VL4-G2(118-134)GS-281 | 0.44 | 19 |
| 281VL4-G2(118-133)GS-281 | 1.46 | 18 |
| 281VL4-G2(118-132)GS-281 | 34.78 | 17 |
| 281VL4-CH1(118-131)-281 | 35.91 | 14 |

Example 46

Evaluation for Antibody Stability

The aggregate content of the antibody solution was measured in accordance with the procedure of Example 18. The result is shown in Table 20.

TABLE 20

Aggregate Content of Respective Purified Antibody

| | Aggregate Content (%) | Number of Linker Amino Acid |
|---|---|---|
| 281VL4-G2(118-143)GS-281 | 1.865 | 27 |
| 281VL4-G2(118-142)GS-281 | 1.875 | 26 |
| 281VL4-G2(118-141)GS-281 | 1.907 | 25 |
| 281VL4-G2(118-140)GS-281 | 1.921 | 24 |
| 281VL4-G2(118-139)GS-281 | 1.786 | 23 |
| 281VL4-G2(118-138)GS-281 | 1.619 | 22 |
| 281VL4-G2(118-137)GS-281 | 1.546 | 21 |
| 281VL4-G2(118-136)GS-281 | — | 20 |
| 281VL4-G2(118-135)GS-281 | 1.254 | 19 |
| 281VL4-G2(118-134)GS-281 | — | 18 |
| 281VL4-G2(118-133)GS-281 | — | 17 |
| 281VL4-G2(118-132)GS-281 | 1.522 | 16 |
| 281VL4-CH1(118-131)-281 | 1.246 | 14 |

INDUSTRIAL APPLICABILITY

The antibody of the present invention exhibits high stability and a characteristic that the antibody can be produced with high productivity, and has usability as an antibody for a drug or in diagnosis.

All the publications, patents, and patent applications, which were cited in this specification, are incorporated herein as reference.

SEQUENCE LISTING (468 sequences)

SEQ ID NO: 1 - DNA, 1480 bp, Homo sapiens
gtcgacgctgaattctggctgaccagggcagccaccagagctccagacaatgtctgtctccttcctcatcttcctgcccgtgctgggcctcccatggggtgtcctgtcacaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactcagacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaggatcc

SEQ ID NO: 2 - protein, 474 aa, Homo sapiens
MSVSFLIFLPVLGLPWGVLSQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3 - DNA, 406 bp, Homo sapiens
actgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaacactttcggccctgggaccaaagtggatatcaaacgtacg

SEQ ID NO: 4 - protein, 126 aa, Homo sapiens
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNTFGPGTKVDIKRT

SEQ ID NO: 5 - DNA, 45 bp, Artificial
  primer
gcaactgcggcccagccggccatggcccaggtgcagctgcaggag

SEQ ID NO: 6 - DNA, 49 bp, Artificial
  primer
ccgaggcgcgcccaccgctgccaccgcctcctgaggagacggtgaccgt

SEQ ID NO: 7 - DNA, 49 bp, Artificial
  primer
cggtgggcgcgcctcgggcggaggtggttcagaaattgtgttgacacag

SEQ ID NO: 8 - DNA, 42 bp, Artificial
  primer
cattctcgagttgcggccgcacgtttgatatccactttggtc

SEQ ID NO: 9 - DNA, 45 bp, Artificial
  Synthetic linker ligating between scFv VH and VL
ggaggcggtggcagcggtgggcgcgcctcgggcggaggtggttca

SEQ ID NO: 10 - protein, 15 aa, Artificial
  Synthetic linker ligating between scFv VH and VL
GGGGSGGRASGGGGS

SEQ ID NO: 11 - DNA, 21 bp, Artificial
  primer
atggactggacctggaggatc

SEQ ID NO: 12 - DNA, 21 bp, Artificial
  primer
atggactggacctggagcatc

SEQ ID NO: 13 - DNA, 21 bp, Artificial
  primer
atggactgcacctggaggatc

SEQ ID NO: 14 - DNA, 21 bp, Artificial
  primer
atggactggacctggagaatc

SEQ ID NO: 15 - DNA, 21 bp, Artificial
  primer
atggactggacctggagggtc

SEQ ID NO: 16 - DNA, 21 bp, Artificial
  primer
atggactggatttggaggatc

SEQ ID NO: 17 - DNA, 21 bp, Artificial
  primer
atggacacactttgctccacg

SEQ ID NO: 18 - DNA, 21 bp, Artificial
  primer
atggacacactttgctacaca

SEQ ID NO: 19 - DNA, 21 bp, Artificial
  primer
atggaattggggctgagctgg

SEQ ID NO: 20 - DNA, 21 bp, Artificial
  primer
atggagttgggactgagctgg

SEQ ID NO: 21 - DNA, 21 bp, Artificial
  primer
atggagtttgggctgagctgg

SEQ ID NO: 22 - DNA, 21 bp, Artificial
  primer
atggagttggggctgagctgg

SEQ ID NO: 23 - DNA, 21 bp, Artificial
  primer
atggaactggggctccgctgg

SEQ ID NO: 24 - DNA, 21 bp, Artificial
  primer
atggagtttggactgagctgg

SEQ ID NO: 25 - DNA, 21 bp, Artificial
  primer
atggagttggggctgtgctgg

SEQ ID NO: 26 - DNA, 21 bp, Artificial
  primer
atggagtttgggcttagctgg

SEQ ID NO: 27 - DNA, 21 bp, Artificial
  primer
atggagttttggctgagctgg

SEQ ID NO: 28 - DNA, 24 bp, Artificial
  primer
atgacggagtttgggctgagctgg

SEQ ID NO: 29 - DNA, 21 bp, Artificial
  primer
atgaaacacctgtggttcttc

SEQ ID NO: 30 - DNA, 21 bp, Artificial
  primer
atgaagcacctgtggttcttc

SEQ ID NO: 31 - DNA, 21 bp, Artificial
  primer
atgaaacatctgtggttcttc

SEQ ID NO: 32 - DNA, 21 bp, Artificial
  primer
atgaagcacctgtggtttttc

SEQ ID NO: 33 - DNA, 21 bp, Artificial
  primer
atggggtcaaccgccatcctc

SEQ ID NO: 34 - DNA, 21 bp, Artificial
  primer
atggggtcaaccgccatcctt

SEQ ID NO: 35 - DNA, 24 bp, Artificial
  primer
atgtctgtctccttcctcatcttc

SEQ ID NO: 36 - DNA, 19 bp, Artificial
  primer
gccagggggaagaccgatg

SEQ ID NO: 37 - DNA, 43 bp, Artificial
  primer
aactgcggcccagccggccatggcccaggtgcagctggtgcag

SEQ ID NO: 38 - DNA, 43 bp, Artificial
  primer
aactgcggcccagccggccatggcccaggtccagcttgtgcag

SEQ ID NO: 39 - DNA, 43 bp, Artificial
  primer
aactgcggcccagccggccatggcccaggttcagctggtgcag

SEQ ID NO: 40 - DNA, 43 bp, Artificial
  primer
aactgcggcccagccggccatggcccaggtccagctggtacag

SEQ ID NO: 41 - DNA, 43 bp, Artificial
  primer
aactgcggcccagccggccatggcccagatgcagctggtgcag

SEQ ID NO: 42 - DNA, 43 bp, Artificial
  primer
aactgcggcccagccggccatggcccaaatgcagctggtgcag

SEQ ID NO: 43 - DNA, 43 bp, Artificial
  primer
aactgcggcccagccggccatggccgaggtccagctggtacag

SEQ ID NO: 44 - DNA, 43 bp, Artificial
  primer
aactgcggcccagccggccatggcccagatcaccttgaaggag

SEQ ID NO: 45 - DNA, 43 bp, Artificial
  primer
aactgcggcccagccggccatggcccaggtcaccttgaaggag

SEQ ID NO: 46 - DNA, 43 bp, Artificial
  primer
aactgcggcccagccggccatggccgaggtgcagctggtggag

SEQ ID NO: 47 - DNA, 43 bp, Artificial
  primer
aactgcggcccagccggccatggccgaagtgcagctggtggag

SEQ ID NO: 48 - DNA, 43 bp, Artificial
  primer
aactgcggcccagccggccatggcccaggtgcagctggtggag

SEQ ID NO: 49 - DNA, 43 bp, Artificial
  primer
aactgcggcccagccggccatggccgaggtgcagctgttggag

SEQ ID NO: 50 - DNA, 43 bp, Artificial
  primer
aactgcggcccagccggccatggcccaggtgcagctgcaggag

SEQ ID NO: 51 - DNA, 43 bp, Artificial
  primer
aactgcggcccagccggccatggcccagctgcagctgcaggag

SEQ ID NO: 52 - DNA, 43 bp, Artificial
  primer
aactgcggcccagccggccatggcccaggtgcagctacagcag

SEQ ID NO: 53 - DNA, 43 bp, Artificial
  primer
aactgcggcccagccggccatggccgaggtgcagctggtgcag

SEQ ID NO: 54 - DNA, 43 bp, Artificial
  primer
aactgcggcccagccggccatggccgaagtgcagctggtgcag

SEQ ID NO: 55 - DNA, 43 bp, Artificial
  primer
aactgcggcccagccggccatggcccaggtacagctgcagcag

SEQ ID NO: 56 - DNA, 43 bp, Artificial
  primer
aactgcggcccagccggccatggcccaggtgcagctggtgcaa

SEQ ID NO: 57 - DNA, 53 bp, Artificial
  primer
ccgaggcgcgcccaccgctgccaccgcctcctgaggagacggtgaccagggtg

SEQ ID NO: 58 - DNA, 53 bp, Artificial
  primer
ccgaggcgcgcccaccgctgccaccgcctcctgaggagacagtgaccagggtg

SEQ ID NO: 59 - DNA, 53 bp, Artificial
  primer
ccgaggcgcgcccaccgctgccaccgcctcctgaagagacggtgaccattgtc

SEQ ID NO: 60 - DNA, 53 bp, Artificial
  primer
ccgaggcgcgcccaccgctgccaccgcctcctgaggagacggtgaccagggtt

SEQ ID NO: 61 - DNA, 53 bp, Artificial
  primer
ccgaggcgcgcccaccgctgccaccgcctcctgaggagacggtgaccgtggtc

SEQ ID NO: 62 - DNA, 663 bp, Homo sapiens
atgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 63 - DNA, 33 bp, Artificial
  primer
atgctcaggctgctcttggctctcaacttattc

SEQ ID NO: 64 - DNA, 27 bp, Artificial
  primer
tcaggagcgataggctgcgaagtcgcg

SEQ ID NO: 65 - DNA, 462 bp, Homo sapiens
atgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgg

SEQ ID NO: 66 - DNA, 31 bp, Artificial
  primer
gggggtaccatgctcaggctgctcttggctc

SEQ ID NO: 67 - DNA, 31 bp, Artificial
  primer
gggtctagaccaaaagggcttagaaggtccg

SEQ ID NO: 68 - DNA, 35 bp, Artificial
  primer
aaaggtgtccagtgtgaggtgcagctggtggagtc

SEQ ID NO: 69 - DNA, 20 bp, Artificial
  primer
tgaggagacggtgaccgtgg

SEQ ID NO: 70 - DNA, 69 bp, Artificial
  primer
ggggtcgacaccatggagtttgggctgagctgggttttccttgttgctattttaaaaggtgtccagtgt

SEQ ID NO: 71 - DNA, 25 bp, Artificial
  primer
ggggctagctgaggagacggtgacc

SEQ ID NO: 72 - DNA, 1419 bp, Homo sapiens
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctgacaaccgaggacacagccgtgtattactgtaacacagatctcccgtattactatggttcggggcgttattcgggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 73 - protein, 472 aa, Homo sapiens
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - DNA, 1419 bp, Homo sapiens
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctaaaaaccgaggacacaggcgtgtattactgtaccacatatctcccgtattactatggttcggagagatggtcgggaatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 75 - protein, 472 aa, Homo sapiens
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLKTEDTGVYYCTTYLPYYYGSERWSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 76 - DNA, 300 bp, Artificial
  Synthetic 341VL34-CH1-341, 341-CH1-341VL34, 341VL36-CH1-341 or 341-CH1-341VL36 H linker
gctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttggatcc

SEQ ID NO: 77 - protein, 100 aa, Artificial
  Synthetic 341VL34-CH1-341, 341-CH1-341VL34, 341VL36-CH1-341 or 341-CH1-341VL36 H linker
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVGS

SEQ ID NO: 78 - DNA, 23 bp, Artificial
  primer
ggggctagcaccaagggcccatc

SEQ ID NO: 79 - DNA, 26 bp, Artificial
  primer
ggatccaactgtcttgtccaccttgg

SEQ ID NO: 80 - DNA, 41 bp, Artificial
  primer
gtggacaagacagttggatcccaggtccaactgcagcagtc

SEQ ID NO: 81 - DNA, 27 bp, Artificial
  primer
cttggtgctagctgaggagacggtgac

SEQ ID NO: 82 - DNA, 2103 bp, Artificial
  Synthetic construct of 341VL34-CH1-341 H chain
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctgacaaccgaggacacagccgtgtattactgtaacacagatctcccgtattactatggttcggggcgttattcgggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttggatcccaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 83 - protein, 700 aa, Artificial
  Synthetic construct of 341VL34-CH1-341 H chain
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVGSQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 84 - DNA, 41 bp, Artificial
  primer
gtggacaagacagttggatccgaggtgcagctggtggagtc

SEQ ID NO: 85 - DNA, 2106 bp, Artificial
  Synthetic construct of 341-CH1-341VL34 H chain
atgtctgtctccttcctcatcttcctgcccgtgctgggcctcccatggggtgtcctgtcacaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttggatccgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctgacaaccgaggacacagccgtgtattactgtaacacagatctcccgtattactatggttcggggcgttattcgggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 86 - protein, 701 aa, Artificial
  Synthetic construct of 341-CH1-341VL34 H chain
MSVSFLIFLPVLGLPWGVLSQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVGSEVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 87 - DNA, 18 bp, Artificial
  Synthetic linker ligating VHs of DVD341VL34-341 and DVD341VL36-341
gctagcaccaagggccca

SEQ ID NO: 88 - protein, 6 aa, Artificial
  Synthetic linker ligating VHs of DVD341VL34-341 and DVD341VL36-341
ASTKGP

SEQ ID NO: 89 - DNA, 18 bp, Artificial
  Synthetic linker ligating VLs of DVD341VL34-341 and DVD341VL36-341
cgtacggtggctgcacca

SEQ ID NO: 90 - protein, 6 aa, Artificial
  Synthetic linker ligating VLs of DVD341VL34-341 and DVD341VL36-341
RTVAAP

SEQ ID NO: 91 - DNA, 47 bp, Artificial
  primer
gtctcctcagctagcaccaagggcccacaggtccaactgcagcagtc

SEQ ID NO: 92 - DNA, 41 bp, Artificial
  primer
gggcgtacggtggctgcaccagaaattgtgttgacacagtc

SEQ ID NO: 93 - DNA, 29 bp, Artificial
  primer
gggcgtacgtttgatatccactttggtcc

SEQ ID NO: 94 - DNA, 1821 bp, Homo sapiens
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctgacaaccgaggacacagccgtgtattactgtaacacagatctcccgtattactatggttcggggcgttattcgggtatggacgtctggggccaagggaccacggtcaccgtctcctcagctagcaccaagggcccacaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 95 - protein, 606 aa, Homo sapiens
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSSASTKGPQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 96 - DNA, 1026 bp, Homo sapiens
atggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaacactttcggccctgggaccaaagtggatatcaaacgtacggtggctgcaccagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaacactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 97 - protein, 341 aa, Homo sapiens [sequence omitted]

SEQ ID NO: 98 - DNA, 984 bp, Artificial
  Synthetic linker of 341VL34-CH1-H-CH2-CH3-341-CH1 or 341VL36-CH1-H-CH2-CH3-341-CH1
gctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggatcc

SEQ ID NO: 99 - protein, 328 aa, Artificial
  Synthetic linker of 341VL34-CH1-H-CH2-CH3-341-CH1 or 341VL36-CH1-H-CH2-CH3-341-CH1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGS

SEQ ID NO: 100 - DNA, 27 bp, Artificial
  primer
gtctcctcagctagcaccaagggccca

SEQ ID NO: 101 - DNA, 30 bp, Artificial
  primer
gggggatcctttacccggagacagggagag

SEQ ID NO: 102 - DNA, 35 bp, Artificial
  primer
gatatcaaaggatcccaggtccaactgcagcagtc

SEQ ID NO: 103 - DNA, 32 bp, Artificial
  primer
gggggatcctcaaactgtcttgtccaccttgg

SEQ ID NO: 104 - DNA, 2103 bp, Artificial
  Synthetic construct of 341VL34-CH1-H-CH2-CH3-341-CH1 H chain
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctgacaaccgaggacacagccgtgtattactgtaacacagatctcccgtattactatggttcggggcgttattcgggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggatcccaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagtttga

SEQ ID NO: 105 - protein, 700 aa, Artificial
  Synthetic construct of 341VL34-CH1-H-CH2-CH3-341-CH1 H chain
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGSQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 106 - DNA, 2103 bp, Artificial
  Synthetic construct
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctaaaaaccgaggacacaggcgtgtattactgtaccacatatctcccgtattactatggttcggagagatggtcgggaatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttggatcccaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 107 - protein, 700 aa, Artificial
  Synthetic construct
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLKTEDTGVYYCTTYLPYYYGSERWSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVGSQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 108 - DNA, 2106 bp, Artificial
  Synthetic construct
atgtctgtctccttcctcatcttcctgcccgtgctgggcctcccatggggtgtcctgtcacaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttggatccgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctaaaaaccgaggacacaggcgtgtattactgtaccacatatctcccgtattactatggttcggagagatggtcgggaatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 109 - protein, 701 aa, Artificial [sequence omitted]

SEQ ID NO: 110 - DNA, 1821 bp, Homo sapiens
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctaaaaaccgaggacacaggcgtgtattactgtaccacatatctcccgtattactatggttcggagagatggtcgggaatggacgtctggggccaagggaccacggtcaccgtctcctcagctagcaccaagggcccacaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 111 - protein, 606 aa, Homo sapiens
MEFGLSWVFLVAILKGVQCEVQLVESGGGLVKPGGSLRLSCGGSGFTFNNAWMNWVRQAPGKGLEWVGRIKGKTDGGTADYAAPVKGRFTISRDYSKNTLYLQMNSLKTEDTGVYYCTTYLPYYYGSERWSGMDVWGQGTTVTVSSASTKGPQVQLQQSGPGLVKPSQTLSLTCAISGDSVSSNSATWNWIRQSPSRDLEWLGRTYYRSKWYRDYVGSVKSRIIINPDTSNNQFSLQLNSVTPEDTAIYYCTRAQWLGGDYPYYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 112 - DNA, 1026 bp, Homo sapiens; identical to SEQ ID NO: 96

SEQ ID NO: 113 - protein, 341 aa, Homo sapiens [sequence omitted]

SEQ ID NO: 114 - DNA, 2103 bp, Artificial
  Synthetic construct of 341VL36-CH1-H- CH2-CH3-341-CH1 H chain
atggagtttgggctgagctgggttttccttgttgctattttaaaaggtgtccagtgtgaggtgcagctggtggagtctgggggaggcttggtaaagcctggggggtcccttagactctcctgtggaggctctggattcactttcaataatgcctggatgaactgggtccgccaggctccagggaaggggctggagtgggttggccgcattaaaggcaagactgatggtgggacagcagactacgctgcacccgtgaaaggcagattcaccatctcaagagattattcaaaaaacacgctgtatctgcaaatgaacagcctaaaaaccgaggacacaggcgtgtattactgtaccacatatctcccgtattactatggttcggagagatggtcgggaatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcctccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggatcccaggtccaactgcagcagtcaggtccaggactggtgaagccctcgcagaccctctcactcacctgtgccatctccggggacagtgtctctagcaacagtgctacttggaactggatcaggcagtccccatcgagagaccttgagtggctgggaaggacatactacaggtccaagtggtatcgtgattatgtaggatctgtgaaaagtcgaataatcatcaacccagacacatccaacaaccagttctccctgcagctgaactctgtgactcccgaggacacggctatatattactgtacaagagcacagtggctgggaggggattacccctactactacagtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagtttga

SEQ ID NO: 115 - protein, 700 aa, Artificial [sequence omitted]

SEQ ID NO: 116 - DNA, 481 bp, Mus musculus
ctgaacacagacccgtcgactttgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagg

SEQ ID NO: 117 - protein, 143 aa, Mus musculus
MKHLWFFLLLVAAPRWVLSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTK

SEQ ID NO: 118 - DNA, 430 bp, Mus musculus
tcacagatctgagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagatcaaacgtacg

SEQ ID NO: 119 - protein, 130 aa, Mus musculus
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRT

SEQ ID NO: 120 - DNA, 45 bp, Artificial; identical to SEQ ID NO: 5
  primer

SEQ ID NO: 121 - DNA, 49 bp, Artificial
  primer
ccgaggcgcgcccaccgctgccaccgcctcctgaggagacggtgaccag

SEQ ID NO: 122 - DNA, 49 bp, Artificial
  primer
cggtgggcgcgcctcgggcggaggtggttcagaaattgtgttgacgcag

SEQ ID NO: 123 - DNA, 48 bp, Artificial
  primer
gagtcattctcgacttgcggccgcacgtttgatctccagtcgtgtccc

SEQ ID NO: 124 - DNA, 56 bp, Artificial
  primer
gtcctcgcaactgcggcccagccggccatggcccagrtgcagctggtgcartctgg

SEQ ID NO: 125 - DNA, 56 bp, Artificial
  primer
gtcctcgcaactgcggcccagccggccatggccsaggtccagctggtrcagtctgg

SEQ ID NO: 126 - DNA, 56 bp, Artificial
  primer
gtcctcgcaactgcggcccagccggccatggcccagrtcaccttgaaggagtctgg

SEQ ID NO: 127 - DNA, 56 bp, Artificial
  primer
gtcctcgcaactgcggcccagccggccatggccsaggtgcagctggtggagtctgg

SEQ ID NO: 128 - DNA, 56 bp, Artificial
  primer
gtcctcgcaactgcggcccagccggccatggcccaggtgcagctacagcagtgggg

SEQ ID NO: 129 - DNA, 56 bp, Artificial
  primer
gtcctcgcaactgcggcccagccggccatggcccagstgcagctgcaggagtcsgg

SEQ ID NO: 130 - DNA, 56 bp, Artificial
  primer
gtcctcgcaactgcggcccagccggccatggccgargtgcagctggtgcagtctgg

SEQ ID NO: 131 - DNA, 56 bp, Artificial
  primer
gtcctcgcaactgcggcccagccggccatggcccaggtacagctgcagcagtcagg

SEQ ID NO: 132 - DNA, 65 bp, Artificial
  primer
cccgaggcgcgcccaccgctgccaccgcctcctgaggagacggtgaccagggtgccyykgcccca

SEQ ID NO: 133 - DNA, 65 bp, Artificial
  primer
cccgaggcgcgcccaccgctgccaccgcctcctgaggagacggtgaccattgtcccyykgcccca

SEQ ID NO: 134 - DNA, 65 bp, Artificial
  primer
cccgaggcgcgcccaccgctgccaccgcctcctgaggagacggtgaccagggttccyykgcccca

SEQ ID NO: 135 - DNA, 65 bp, Artificial
  primer
cccgaggcgcgcccaccgctgccaccgcctcctgaggagacggtgaccgtggtcccyykccccca

SEQ ID NO: 136 - DNA, 48 bp, Artificial
  primer
ctgctggtggcggctcccagatgggtcctgtccgaggtccagctggtg

SEQ ID NO: 137 - DNA, 17 bp, Artificial
  primer
tgaggagacggtgacca

SEQ ID NO: 138 - DNA, 49 bp, Artificial
  primer
ggggtcgacaccatgaagcacctgtggttcttcctcctgctggtggcgg

SEQ ID NO: 139 - DNA, 26 bp, Artificial
  primer
ggggctagctgaggagacggtgacca

SEQ ID NO: 140 - DNA, 1419 bp, Artificial
  Synthetic construct of 281VL4
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 141 - protein, 472 aa, Artificial [sequence omitted]

SEQ ID NO: 142 - DNA, 300 bp, Artificial
  Synthetic construct of 281VL4-CH1-281
gctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttggatcc

SEQ ID NO: 143 - protein, 100 aa, Artificial
  Synthetic construct of 281VL4-CH1-281
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGS

SEQ ID NO: 144 - DNA, 21 bp, Artificial
  primer
ggggctagcaccaaggggcca

SEQ ID NO: 145 - DNA, 24 bp, Artificial
  primer
ggatccaactctcttgtccacctt

SEQ ID NO: 146 - DNA, 30 bp, Artificial
  primer
aagagagttggatcccaggtgcagctgcag

SEQ ID NO: 147 - DNA, 26 bp, Artificial
  primer
ggggctagctgaggagacggtgacca

SEQ ID NO: 148 - DNA, 2079 bp, Artificial
  Synthetic construct of 281VL4-CH1-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 149 - protein, 692 aa, Artificial [sequence omitted]

SEQ ID NO: 150 - DNA, 41 bp, Artificial
  primer
gtcttccccctggcgccctgccaggtgcagctgcaggagtc

SEQ ID NO: 151 - DNA, 42 bp, Artificial
  primer
ggggctagcaccaaggggccatccgtcttccccctggcgccc

SEQ ID NO: 152 - DNA, 1821 bp, Artificial
  Synthetic construct of 281VL4-CH1(118-131)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 153 - protein, 606 aa, Artificial
  Synthetic construct of 281VL4-CH1(118-131)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 154 - DNA, 38 bp, Artificial
  primer
gtcttccccctggcgccccaggtgcagctgcaggagtc

SEQ ID NO: 155 - DNA, 1818 bp, Artificial
  Synthetic construct of 281VL4-CH1(118-130)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgccccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 156 - protein, 605 aa, Artificial
  Synthetic construct of 281VL4-CH1(118-130)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 157 - DNA, 1821 bp, Artificial
  Synthetic construct of 281VL4-CH1(118-131/C131S)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgccctcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 158 - protein, 606 aa, Artificial
  Synthetic construct of 281VL4-CH1(118-131/C131S)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 159 - DNA, 1788 bp, Artificial
  Synthetic construct of 281VL4-CH1(118-119+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 160 - protein, 595 aa, Artificial
  Synthetic construct of 281VL4-CH1(118-119+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 161 - DNA, 1791 bp, Artificial
  Synthetic construct of 281VL4-CH1(118-120+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcacctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 162 - protein, 596 aa, Artificial
  Synthetic construct of 281VL4-CH1(118-120+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 163 - DNA, 1794 bp, Artificial
  Synthetic construct of 281VL4-CH1(118-121+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagtgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 164 - protein, 597 aa, Artificial
  Synthetic construct of 281VL4-CH1(118-121+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 165 - DNA, 1797 bp, Artificial
  Synthetic construct of 281VL4-CH1(118-122+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggtgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 166 - protein, 598 aa, Artificial
  Synthetic construct of 281VL4-CH1(118-122+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 167 - DNA, 1800 bp, Artificial
  Synthetic construct of 281VL4-CH1(118-123+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 168 - protein, 599 aa, Artificial
  Synthetic construct of 281VL4-CH1(118-123+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 169 - DNA, 1803 bp, Artificial
  Synthetic construct of 281VL4-CH1(118-124+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatcctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 170 - protein, 600 aa, Artificial
  Synthetic construct of 281VL4-CH1(118-124+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 171 - DNA, 1806 bp, Artificial
  Synthetic construct of 281VL4-CH1(118-125+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 172 - protein, 601 aa, Artificial
  Synthetic construct of 281VL4-CH1(118-125+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 173 - DNA, 1809 bp, Artificial
  Synthetic construct of 281VL4-CH1(118-126+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 174 - protein, 602 aa, Artificial
  Synthetic construct of 281VL4-CH1(118-126+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 175 - DNA, 1812 bp, Artificial
  Synthetic construct of 281VL4-CH1(118-127+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttcccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 176 - protein, 603 aa, Artificial
  Synthetic construct of 281VL4-CH1(118-127+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 177 - DNA, 1815 bp, Artificial
  Synthetic construct of 281VL4-CH1(118-128+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctgtgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 178 - protein, 604 aa, Artificial
  Synthetic construct of 281VL4-CH1(118-128+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - DNA, 1818 bp, Artificial
  Synthetic construct of 281VL4-CH1(118-129+C)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgtgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 180 - protein, 605 aa, Artificial
  Synthetic construct of 281VL4-CH1(118-129+C)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLACQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - DNA, 1821 bp, Artificial
  Synthetic construct of 281VL4-CH1(118-131/A118S)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcatctagcaccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 182 - protein, 606 aa, Artificial
  Synthetic construct of 281VL4-CH1(118-131/A118S)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSSSTKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - DNA, 1821 bp, Artificial
  Synthetic construct of 281VL4-CH1(118-131/S119A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctgccaccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 184 - protein, 606 aa, Artificial
  Synthetic construct of 281VL4-CH1(118-131/S119A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSAATKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 185 - DNA, 1821 bp, Artificial
  Synthetic construct of 281VL4-CH1(118-131/T120A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcgccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 186 - protein, 606 aa, Artificial
  Synthetic construct of 281VL4-CH1(118-131/T120A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASAKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 187 - DNA, 1821 bp, Artificial
  Synthetic construct of 281VL4-CH1(118-131/K121A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccgcggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 188 - protein, 606 aa, Artificial
  Synthetic construct of 281VL4-CH1(118-131/K121A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTAGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 189 - DNA, 1821 bp, Artificial
  Synthetic construct of 281VL4-CH1(118-131/G122A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggcgccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 190 - protein, 606 aa, Artificial
  Synthetic construct of 281VL4-CH1(118-131/G122A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKAPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 191 - DNA, 1821 bp, Artificial
  Synthetic construct of 281VL4-CH1(118-131/P123A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggggcatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 192 - protein, 606 aa, Artificial
  Synthetic construct of 281VL4-CH1(118-131/P123A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGASVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 193 - DNA, 1821 bp, Artificial
  Synthetic construct of 281VL4-CH1(118-131/S124A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccagccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 194 - protein, 606 aa, Artificial
  Synthetic construct of 281VL4-CH1(118-131/S124A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPAVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 195 - DNA, 1821 bp, Artificial
  Synthetic construct of 281VL4-CH1(118-131/V125A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgccttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 196 - protein, 606 aa, Artificial
  Synthetic construct of 281VL4-CH1(118-131/V125A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSAFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 197 - DNA, 1821 bp, Artificial
  Synthetic construct of 281VL4-CH1(118-131/F126A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcgcccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 198 - protein, 606 aa, Artificial
  Synthetic construct of 281VL4-CH1(118-131/F126A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVAPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 199 - DNA, 1821 bp, Artificial
  Synthetic construct of 281VL4-CH1(118-131/P127A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttcgccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 200 - protein, 606 aa, Artificial
  Synthetic construct of 281VL4-CH1(118-131/P127A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFALAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 201 - DNA, 1821 bp, Artificial
  Synthetic construct of 281VL4-CH1(118-131/L128A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccgcggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 202 - protein, 606 aa, Artificial
  Synthetic construct of 281VL4-CH1(118-131/L128A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPAAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 203 - DNA, 1821 bp, Artificial
  Synthetic construct of 281VL4-CH1(118-131/A129S)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctgtcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 204 - protein, 606 aa, Artificial
  Synthetic construct of 281VL4-CH1(118-131/A129S)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLSPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205 - DNA, 1821 bp, Artificial
  Synthetic construct of 281VL4-CH1(118-131/P130A)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcggcctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 206 - protein, 606 aa, Artificial
  Synthetic construct of 281VL4-CH1(118-131/P130A)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAACQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 207 - DNA, 1821 bp, Artificial
  Synthetic construct of 281VL4-CH1(IGHA)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcatccccgaccagccccaaggtcttcccgctgagcctctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 208 - protein, 606 aa, Artificial
  Synthetic construct of 281VL4-CH1(IGHA)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASPTSPKVFPLSLCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 209 - DNA, 1821 bp, Artificial
  Synthetic construct of 281VL4-CH1(IGHD(14))-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcacccaccaaggctccggatgtgttccccatcatatcatgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 210 - protein, 606 aa, Artificial
  Synthetic construct of 281VL4-CH1(IGHD(14))-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSAPTKAPDVFPIISCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - DNA, 1824 bp, Artificial
  Synthetic construct of 281VL4-CH1(IGHD(15))-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcacccaccaaggctccggatgtgttccccatcatatcagggtgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 212 - protein, 607 aa, Artificial
  Synthetic construct of 281VL4-CH1(IGHD(15))-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSAPTKAPDVFPIISGCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - DNA, 1821 bp, Artificial
  Synthetic construct of 281VL4-CH1(IGHE)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcctccacacagagcccatccgtcttccccttgacccgctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 214 - protein, 606 aa, Artificial
  Synthetic construct of 281VL4-CH1(IGHE)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTQSPSVFPLTRCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - DNA, 1821 bp, Artificial
  Synthetic construct of 281VL4-CH1(IGHGP)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcctccaccaagggcccatcggtcttccccctggtgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 216 - protein, 606 aa, Artificial
  Synthetic construct of 281VL4-CH1(IGHGP)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLVPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 217 - DNA, 1821 bp, Artificial
  Synthetic construct of 281VL4-CH1(IGHM)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagggagtgcatccgccccaacccttttccccctcgtctcctgtcaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 218 - protein, 606 aa, Artificial
  Synthetic construct of 281VL4-CH1(IGHM)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSGSASAPTLFPLVSCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 219 - DNA, 1821 bp, Artificial
  Synthetic construct of 281VL4-CH1(118-131/A118G)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcaggcagcaccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 220 - protein, 606 aa, Artificial
  Synthetic construct of 281VL4-CH1(118-131/A118G)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSGSTKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 221 - DNA, 1821 bp, Artificial
  Synthetic construct of 281VL4-CH1(118-131/S119T)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctaccaccaaggggccatccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 222 - protein, 606 aa, Artificial
  Synthetic construct of 281VL4-CH1(118-131/S119T)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSATTKGPSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 223 - DNA, 1821 bp, Artificial
  Synthetic construct of 281VL4-CH1(118-131/P123F)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggttctccgtcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 224 - protein, 606 aa, Artificial
  Synthetic construct of 281VL4-CH1(118-131/P123F)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGFSVFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 225 - DNA, 1821 bp, Artificial
  Synthetic construct of 281VL4-CH1(118-131/V125L)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccctgttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 226 - protein, 606 aa, Artificial
  Synthetic construct of 281VL4-CH1(118-131/V125L)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSLFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 227 - DNA, 1821 bp, Artificial
  Synthetic construct of 281VL4-CH1(118-131/V125I)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccatcttccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 228 - protein, 606 aa, Artificial
  Synthetic construct of 281VL4-CH1(118-131/V125I)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSIFPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 229 - DNA, 1821 bp, Artificial
  Synthetic construct of 281VL4-CH1(118-131/F126L)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcctgcccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 230 - protein, 606 aa, Artificial
  Synthetic construct of 281VL4-CH1(118-131/F126L)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVLPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 231 - DNA, 1821 bp, Artificial
  Synthetic construct of 281VL4-CH1(118-131/F126Y)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtctaccccctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 232 - protein, 606 aa, Artificial
  Synthetic construct of 281VL4-CH1(118-131/F126Y)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVYPLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 233 - DNA, 1821 bp, Artificial
  Synthetic construct of 281VL4-CH1(118-131/P127G)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttcggcctggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 234 - protein, 606 aa, Artificial
  Synthetic construct of 281VL4-CH1(118-131/P127G)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFGLAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 235 - DNA, 1821 bp, Artificial
  Synthetic construct of 281VL4-CH1(118-131/L128V)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccgtggcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 236 - protein, 606 aa, Artificial
  Synthetic construct of 281VL4-CH1(118-131/L128V)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPVAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 237 - DNA, 1821 bp, Artificial
  Synthetic construct of 281VL4-CH1(118-131/L128I)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccatcgcgccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 238 - protein, 606 aa, Artificial
  Synthetic construct of 281VL4-CH1(118-131/L128I)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPIAPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 239 - DNA, 1821 bp, Artificial
  Synthetic construct of 281VL4-CH1(118-131/A129I)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctgatcccctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 240 - protein, 606 aa, Artificial
  Synthetic construct of 281VL4-CH1(118-131/A129I)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLIPCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 241 - DNA, 1821 bp, Artificial
  Synthetic construct of 281VL4-CH1(118-131/P130F)-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaaggggccatccgtcttccccctggcgttctgccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 242 - protein, 606 aa, Artificial
  Synthetic construct of 281VL4-CH1(118-131/P130F)-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAFCQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 243 - DNA, 81 bp, Artificial
  primer
gctagcccgaccagccccaaggtcttcccgctgagcctctgcagcacccagccagatgggaacgtggtcatcgccggatcc

SEQ ID NO: 244 - protein, 27 aa, Artificial
  primer
ASPTSPKVFPLSLCSTQPDGNVVIAGS

SEQ ID NO: 245 - DNA, 81 bp, Artificial
  primer
gctagcccgaccagccccaaggtcttcccgctgagcctctgcagcaccccccaagatgggaacgtggtcgtcgcaggatcc

SEQ ID NO: 246 - protein, 27 aa, Artificial
  primer
ASPTSPKVFPLSLCSTPQDGNVVVAGS

SEQ ID NO: 247 - DNA, 87 bp, Artificial
  primer
gcacccaccaaggctccggatgtgttccccatcatatcagggtgcagacacccaaaggataacagccctgtggtcctggcaggatcc

SEQ ID NO: 248 - protein, 29 aa, Artificial
  primer
APTKAPDVFPIISGCRHPKDNSPVVLAGS

SEQ ID NO: 249 - DNA, 90 bp, Artificial
  primer
gctagcacacagagcccatccgtcttccccttgacccgctgctgcaaaaacattccctccaatgccacctccgtgactctgggcggatcc

SEQ ID NO: 250 - protein, 30 aa, Artificial
  primer
ASTQSPSVFPLTRCCKNIPSNATSVTLGGS

SEQ ID NO: 251 - DNA, 84 bp, Artificial
  primer
gctagcaccaagggcccatcggtcttccccctggcaccctgctccaagagcacctctgggggcacagcggccctgggcggatcc

SEQ ID NO: 252 - protein, 28 aa, Artificial
  primer
ASTKGPSVFPLAPCSKSTSGGTAALGGS

SEQ ID NO: 253 - DNA, 84 bp, Artificial
  primer
gctagcaccaagggcccatcggtcttccccctggcgccctgctccaggagcacctccgagagcacagccgccctgggcggatcc

SEQ ID NO: 254 - protein, 28 aa, Artificial
  primer
ASTKGPSVFPLAPCSRSTSESTAALGGS

SEQ ID NO: 255 - DNA, 84 bp, Artificial
  primer
gctagcaccaagggcccatcggtcttccccctggcgccctgctccaggagcacctctgggggcacagcggccctgggcggatcc

SEQ ID NO: 256 - protein, 28 aa, Artificial
  primer
ASTKGPSVFPLAPCSRSTSGGTAALGGS

SEQ ID NO: 257 - DNA, 84 bp, Artificial
  primer
gctagcaccaagggcccatcggtcttccccctggtgccctgctccaggagcgtctctgagggcacagcggccctgggcggatcc

SEQ ID NO: 258 - protein, 28 aa, Artificial
  primer
ASTKGPSVFPLVPCSRSVSEGTAALGGS

SEQ ID NO: 259 - DNA, 87 bp, Artificial
  primer
gggagtgcatccgccccaacccttttccccctcgtctcctgtgagaattccccgtcggatacgagcagcgtggccgttggcggatcc

SEQ ID NO: 260 - protein, 29 aa, Artificial
  primer
GSASAPTLFPLVSCENSPSDTSSVAVGGS

SEQ ID NO: 261 - DNA, 1860 bp, Artificial
  Synthetic construct of 281VL4-A1(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcccgaccagccccaaggtcttcccgctgagcctctgcagcacccagccagatgggaacgtggtcatcgccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 262 - protein, 619 aa, Artificial
  Synthetic construct of 281VL4-A1(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASPTSPKVFPLSLCSTQPDGNVVIAGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 263 - DNA, 1860 bp, Artificial
  Synthetic construct of 281VL4-A2(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcccgaccagccccaaggtcttcccgctgagcctctgcagcaccccccaagatgggaacgtggtcgtcgcaggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 264 - protein, 619 aa, Artificial
  Synthetic construct of 281VL4-A2(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASPTSPKVFPLSLCSTPQDGNVVVAGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 265 - DNA, 1869 bp, Artificial
  Synthetic construct of 281VL4-E(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcacacagagcccatccgtcttccccttgacccgctgctgcaaaaacattccctccaatgccacctccgtgactctgggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 266 - protein, 622 aa, Artificial [sequence omitted]

SEQ ID NO: 267 - DNA, 1863 bp, Artificial
  Synthetic construct of 281VL4-G1(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcaccctgctccaagagcacctctgggggcacagcggccctgggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 268 - protein, 620 aa, Artificial
  Synthetic construct of 281VL4-G1(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSKSTSGGTAALGGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 269 - DNA, 1863 bp, Artificial
  Synthetic construct of 281VL4-G2(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcacagccgccctgggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 270 - protein, 620 aa, Artificial
  Synthetic construct of 281VL4-G2(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESTAALGGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 271 - DNA, 1863 bp, Artificial
  Synthetic construct of 281VL4-G3(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctctgggggcacagcggccctgggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 272 - protein, 620 aa, Artificial
  Synthetic construct of 281VL4-G3(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSGGTAALGGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 273 - DNA, 1863 bp, Artificial
  Synthetic construct of 281VL4-HGP(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggtgccctgctccaggagcgtctctgagggcacagcggccctgggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 274 - protein, 620 aa, Artificial
  Synthetic construct of 281VL4-HGP(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLVPCSRSVSEGTAALGGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 275 - DNA, 49 bp, Artificial
  primer
ctagctagctgaggagacggtgaccagggttccctggccccaggggtgg

SEQ ID NO: 276 - DNA, 49 bp, Artificial
  primer
gccctgtggtcctggcaggatcccaggtgcagctgcaggagtcgggccc

SEQ ID NO: 277 - DNA, 48 bp, Artificial
  primer
acgagcagcgtggccgttggcggatcccaggtgcagctgcaggagtcg

SEQ ID NO: 278 - DNA, 49 bp, Artificial
  primer
catatcagggtgcagacacccaaaggataacagccctgtggtcctggca

SEQ ID NO: 279 - DNA, 49 bp, Artificial
  primer
ctcgtctcctgtgagaattccccgtcggatacgagcagcgtggccgttg

SEQ ID NO: 280 - DNA, 49 bp, Artificial
  primer
gcacccaccaaggctccggatgtgttccccatcatatcagggtgcagac

SEQ ID NO: 281 - DNA, 49 bp, Artificial
  primer
gggagtgcatccgccccaacccttttccccctcgtctcctgtgagaatt

SEQ ID NO: 282 - DNA, 49 bp, Artificial
  primer
catccggagccttggtgggtgctgaggagacggtgaccattgtcccttg

SEQ ID NO: 283 - DNA, 49 bp, Artificial
  primer
gggttggggcggatgcactccctgaggagacggtgaccattgtcccttg

SEQ ID NO: 284 - DNA, 1866 bp, Artificial
  Synthetic construct of 281VL4-D(118-144)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagcacccaccaaggctccggatgtgttccccatcatatcagggtgcagacacccaaaggataacagccctgtggtcctggcaggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 285 - protein, 621 aa, Artificial
  Synthetic construct of 281VL4-D(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSAPTKAPDVFPIISGCRHPKDNSPVVLAGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 286 - DNA, 1866 bp, Artificial
  Synthetic construct of 281VL4-M(118-143)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagggagtgcatccgccccaacccttttccccctcgtctcctgtgagaattccccgtcggatacgagcagcgtggccgttggcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 287 - protein, 619 aa, Artificial
  Synthetic construct of 281VL4-M(118-143)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSGSASAPTLFPLVSCENSPSDTSSVAVGQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 288 - DNA, 81 bp, Artificial
  primer
gctagcaccaagggcccatcggtcttccccctggcgccctgctccaggagcacctccgagagcacagccgccctgggatcc

SEQ ID NO: 289 - protein, 27 aa, Artificial
  primer
ASTKGPSVFPLAPCSRSTSESTAALGS

SEQ ID NO: 290 - DNA, 78 bp, Artificial
  primer
gctagcaccaagggcccatcggtcttccccctggcgccctgctccaggagcacctccgagagcacagccgccggatcc

SEQ ID NO: 291 - protein, 26 aa, Artificial
  primer
ASTKGPSVFPLAPCSRSTSESTAAGS

SEQ ID NO: 292 - DNA, 75 bp, Artificial
  primer
gctagcaccaagggcccatcggtcttccccctggcgccctgctccaggagcacctccgagagcacagccggatcc

SEQ ID NO: 293 - protein, 25 aa, Artificial
  primer
ASTKGPSVFPLAPCSRSTSESTAGS

SEQ ID NO: 294 - DNA, 72 bp, Artificial
  primer
gctagcaccaagggcccatcggtcttccccctggcgccctgctccaggagcacctccgagagcacaggatcc

SEQ ID NO: 295 - protein, 24 aa, Artificial
  primer
ASTKGPSVFPLAPCSRSTSESTGS

SEQ ID NO: 296 - DNA, 69 bp, Artificial
  primer
gctagcaccaagggcccatcggtcttccccctggcgccctgctccaggagcacctccgagagcggatcc

SEQ ID NO: 297 - protein, 23 aa, Artificial
  primer
ASTKGPSVFPLAPCSRSTSESGS

SEQ ID NO: 298 - DNA, 66 bp, Artificial
  primer
gctagcaccaagggcccatcggtcttccccctggcgccctgctccaggagcacctccgagggatcc

SEQ ID NO: 299 - protein, 22 aa, Artificial
  primer
ASTKGPSVFPLAPCSRSTSEGS

SEQ ID NO: 300 - DNA, 63 bp, Artificial
  primer
gctagcaccaagggcccatcggtcttccccctggcgccctgctccaggagcacctccggatcc

SEQ ID NO: 301 - protein, 21 aa, Artificial
  primer
ASTKGPSVFPLAPCSRSTSGS

SEQ ID NO: 302 - DNA, 60 bp, Artificial
  primer
gctagcaccaagggcccatcggtcttccccctggcgccctgctccaggagcaccggatcc

SEQ ID NO: 303 - protein, 20 aa, Artificial
  primer
ASTKGPSVFPLAPCSRSTGS

SEQ ID NO: 304 - DNA, 57 bp, Artificial
  primer
gctagcaccaagggcccatcggtcttccccctggcgccctgctccaggagcggatcc

SEQ ID NO: 305 - protein, 19 aa, Artificial
  primer
ASTKGPSVFPLAPCSRSGS

SEQ ID NO: 306 - DNA, 54 bp, Artificial
  primer
gctagcaccaagggcccatcggtcttccccctggcgccctgctccaggggatcc

SEQ ID NO: 307 - protein, 18 aa, Artificial
  primer
ASTKGPSVFPLAPCSRGS

SEQ ID NO: 308 - DNA, 51 bp, Artificial
  primer
gctagcaccaagggcccatcggtcttccccctggcgccctgctccggatcc

SEQ ID NO: 309 - protein, 17 aa, Artificial
  primer
ASTKGPSVFPLAPCSGS

SEQ ID NO: 310 - DNA, 42 bp, Artificial
  primer
gctagcaccaagggcccatcggtcttccccctggcgccctgc

SEQ ID NO: 311 - protein, 14 aa, Artificial
  primer
ASTKGPSVFPLAPC

SEQ ID NO: 312 - DNA, 1860 bp, Artificial
  Synthetic construct of 281VL4-G2(118-142)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcacagccgccctgggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 313 - protein, 619 aa, Artificial
  Synthetic construct of 281VL4-G2(118-142)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESTAALGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 314 - DNA, 1857 bp, Artificial
  Synthetic construct of 281VL4-G2(118-141)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcacagccgccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 315 - protein, 618 aa, Artificial
  Synthetic construct of 281VL4-G2(118-141)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESTAAGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 316 - DNA, 1854 bp, Artificial
  Synthetic construct of 281VL4-G2(118-140)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcacagccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 317 - protein, 617 aa, Artificial
  Synthetic construct of 281VL4-G2(118-140)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESTAGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 318 - DNA, 1851 bp, Artificial
  Synthetic construct of 281VL4-G2(118-139)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcacaggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 319 - protein, 616 aa, Artificial
  Synthetic construct of 281VL4-G2(118-139)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESTGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 320 - DNA, 1848 bp, Artificial
  Synthetic construct of 281VL4-G2(118-138)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagagcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 321 - protein, 615 aa, Artificial
  Synthetic construct of 281VL4-G2(118-138)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSESGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 322 - DNA, 1845 bp, Artificial
  Synthetic construct of 281VL4-G2(118-137)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccgagggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 323 - protein, 614 aa, Artificial
  Synthetic construct of 281VL4-G2(118-137)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSEGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 324 - DNA, 1842 bp, Artificial
  Synthetic construct of 281VL4-G2(118-136)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcacctccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 325 - protein, 613 aa, Artificial
  Synthetic construct of 281VL4-G2(118-136)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTSGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 326 - DNA, 1839 bp, Artificial
  Synthetic construct of 281VL4-G2(118-135)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcaccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 327 - protein, 612 aa, Artificial
  Synthetic construct of 281VL4-G2(118-135)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSTGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 328 - DNA, 1836 bp, Artificial
  Synthetic construct of 281VL4-G2(118-134)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggagcggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 329 - protein, 611 aa, Artificial
  Synthetic construct of 281VL4-G2(118-134)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRSGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 330 - DNA, 1833 bp, Artificial
  Synthetic construct of 281VL4-G2(118-133)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccaggggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 331 - protein, 610 aa, Artificial
  Synthetic construct of 281VL4-G2(118-133)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSRGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - DNA, 1830 bp, Artificial
  Synthetic construct of 281VL4-G2(118-132)GS-281
atgaagcacctgtggttcttcctcctgctggtggcggctcccagatgggtcctgtccgaggtccagctggtgcagtctgggtctgagctgaagaagcctgggtcctcggtgaaggtctcctgcaaggcttctggaggcacctccaggagctttgctatcagctgggtgcgacaggcccctggacaaggacttgagtggatgggagggatcatccctatctttggtccagcaaactacgcacagaagttccagggcagagtcacgattaccgcggacgaatccacgagcacagcctacatggagctgagtagcctgagatctgaggacacggccgtgtattactgtgcgaggcacgctattgctatgggttggggagttattacaacgaactactttgactcctggggccaagggacaatggtcaccgtctcctcagctagcaccaagggcccatcggtcttccccctggcgccctgctccggatcccaggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacagtgggagcaccaactacaatccctccctcaagagtcgagtcaccatatcagtagacacgtccaagaaccagttctccctgaagctgaattctgtgaccgctgcggacacggccgtgtattactgtgcgagagcccccttgcacggtgactacaaatggttccacccctggggccagggaaccctggtcaccgtctcctcagctagcaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatga

SEQ ID NO: 333 - protein, 609 aa, Artificial
  Synthetic construct of 281VL4-G2(118-132)GS-281
MKHLWFFLLLVAAPRWVLSEVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSSASTKGPSVFPLAPCSGSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 334 - protein, 14 aa, Artificial
  Synthetic construct of CH1(IGHA)
ASPTSPKVFPLSLC

SEQ ID NO: 335 - protein, 14 aa, Artificial
  Synthetic construct of CH1(IGHD(14))
APTKAPDVFPIISC

SEQ ID NO: 336 - protein, 14 aa, Artificial
  Synthetic construct of CH1(IGHE)
ASTQSPSVFPLTRC

SEQ ID NO: 337 - protein, 14 aa, Artificial
  Synthetic construct of CH1(IGHGP)
ASTKGPSVFPLVPC

SEQ ID NO: 338 - protein, 14 aa, Artificial
  Synthetic construct of CH1(IGHM)
GSASAPTLFPLVSC

SEQ ID NO: 339 - protein, 14 aa, Artificial
  Synthetic construct of CH1(118-131/A118G)
GSTKGPSVFPLAPC

SEQ ID NO: 340 - protein, 14 aa, Artificial
  Synthetic construct of CH1(118-131/S119T)
ATTKGPSVFPLAPC

SEQ ID NO: 341 - protein, 14 aa, Artificial
  Synthetic construct of CH1(118-131/P123F)
ASTKGFSVFPLAPC

SEQ ID NO: 342 - protein, 14 aa, Artificial
  Synthetic construct of CH1(118-131/V125L)
ASTKGPSLFPLAPC

SEQ ID NO: 343 - protein, 14 aa, Artificial
  Synthetic construct of CH1(118-131/V125I)
ASTKGPSIFPLAPC

SEQ ID NO: 344 - protein, 14 aa, Artificial
  Synthetic construct of CH1(118-131/F126L)
ASTKGPSVLPLAPC

SEQ ID NO: 345 - protein, 14 aa, Artificial
  Synthetic construct of CH1(118-131/F126Y)
ASTKGPSVYPLAPC

SEQ ID NO: 346 - protein, 14 aa, Artificial
  Synthetic construct of CH1(118-131/P127G)
ASTKGPSVFGLAPC

SEQ ID NO: 347 - protein, 14 aa, Artificial
  Synthetic construct of CH1(118-131/L128V)
ASTKGPSVFPVAPC

SEQ ID NO: 348 - protein, 14 aa, Artificial
  Synthetic construct of CH1(118-131/L128I)
ASTKGPSVFPIAPC

SEQ ID NO: 349 - protein, 14 aa, Artificial
  Synthetic construct of CH1(118-131/A129I)
ASTKGPSVFPLIPC

SEQ ID NO: 350 - protein, 14 aa, Artificial
  Synthetic construct of CH1(118-131/A118S)
SSTKGPSVFPLAPC

SEQ ID NO: 351 - protein, 14 aa, Artificial
  Synthetic construct of CH1(118-131/S119A)
AATKGPSVFPLAPC

SEQ ID NO: 352 - protein, 14 aa, Artificial
  Synthetic construct of CH1(118-131/T120A)
ASAKGPSVFPLAPC

SEQ ID NO: 353 - protein, 14 aa, Artificial
  Synthetic construct of CH1(118-131/K121A)
ASTAGPSVFPLAPC

SEQ ID NO: 354 - protein, 14 aa, Artificial
  Synthetic construct of CH1(118-131/G122A)
ASTKAPSVFPLAPC

SEQ ID NO: 355 - protein, 14 aa, Artificial
  Synthetic construct of CH1(118-131/P123A)
ASTKGASVFPLAPC

SEQ ID NO: 356 - protein, 14 aa, Artificial
  Synthetic construct of CH1(118-131/S124A)
ASTKGPAVFPLAPC

SEQ ID NO: 357 - protein, 14 aa, Artificial
  Synthetic construct of CH1(118-131/V125A)
ASTKGPSAFPLAPC

SEQ ID NO: 358 - protein, 14 aa, Artificial
  Synthetic construct of CH1(118-131/F126A)
ASTKGPSVAPLAPC

SEQ ID NO: 359 - protein, 14 aa, Artificial
  Synthetic construct of CH1(118-131/P127A)
ASTKGPSVFALAPC

SEQ ID NO: 360 - protein, 14 aa, Artificial [sequence omitted]

SEQ ID NO: 361 - protein, 14 aa, Artificial
  Synthetic construct of CH1(118-131/A129S)
ASTKGPSVFPLSPC

SEQ ID NO: 362 - protein, 25 aa, Artificial
  Synthetic construct of 281VL4-A1 (118-142)281
ASPTSPKVFPLSLCSTQPDGNVVIA

SEQ ID NO: 363 - protein, 25 aa, Artificial
  Synthetic construct of 281VL4-A2 (118-142)281
ASPTSPKVFPLSLCSTPQDGNVVVA

SEQ ID NO: 364 - protein, 27 aa, Artificial
  Synthetic construct of 281VL4-D (118-144)281
APTKAPDVFPIISGCRHPKDNSPVVLA

SEQ ID NO: 365 - protein, 28 aa, Artificial
  Synthetic construct of 281VL4-E (118-145)281
ASTQSPSVFPLTRCCKNIPSNATSVTLG

SEQ ID NO: 366 - protein, 26 aa, Artificial
  Synthetic construct of 281VL4-G1 (118-143)281
ASTKGPSVFPLAPCSKSTSGGTAALG

SEQ ID NO: 367 - protein, 26 aa, Artificial
  Synthetic construct of 281VL4-G2 (118-143)281
ASTKGPSVFPLAPCSRSTSESTAALG

SEQ ID NO: 368 - protein, 26 aa, Artificial
  Synthetic construct of 281VL4-G3 (118-143)281
ASTKGPSVFPLAPCSRSTSGGTAALG

SEQ ID NO: 369 - protein, 26 aa, Artificial
  Synthetic construct of 281VL4-HGP (118-143)281
ASTKGPSVFPLVPCSRSVSEGTAALG

SEQ ID NO: 370 - protein, 27 aa, Artificial
  Synthetic construct of 281VL4-M (118-144)281
GSASAPTLFPLVSCENSPSDTSSVAVG

SEQ ID NO: 371 - protein, 18 aa, Artificial
  Synthetic construct of 281VL4-G2 (118-135)281
ASTKGPSVFPLAPCSRST

SEQ ID NO: 372 - protein, 17 aa, Artificial
  Synthetic construct of 281VL4-G2 (118-134)281
ASTKGPSVFPLAPCSRS

SEQ ID NO: 373 - protein, 16 aa, Artificial
  Synthetic construct of 281VL4-G2 (118-133)281
ASTKGPSVFPLAPCSR

SEQ ID NO: 374 - protein, 15 aa, Artificial
  Synthetic construct of 281VL4-G2 (118-132)281
ASTKGPSVFPLAPCS

SEQ ID NO: 375 - protein, 15 aa, Artificial
  Synthetic construct of CH1(IGHD(15))
APTKAPDVFPIISGC

SEQ ID NO: 376 - protein, 5 aa, Artificial Sequence
  Synthetic peptide
GGGGS

SEQ ID NO: 377 - protein, 100 aa, Artificial Sequence; identical to SEQ ID NO: 143
  Synthetic peptide

SEQ ID NO: 378 - DNA, 300 bp, Artificial Sequence; identical to SEQ ID NO: 142
  Synthetic polynucleotide

SEQ ID NO: 379 - protein, 14 aa, Artificial Sequence
  Synthetic peptide
ASTKGPSVFPLAPC

SEQ ID NO: 380 - DNA, 42 bp, Artificial Sequence
  Synthetic polynucleotide
gctagcaccaaggggccatccgtcttccccctggcgccctgc

SEQ ID NO: 381 - protein, 13 aa, Artificial Sequence
  Synthetic peptide
ASTKGPSVFPLAP

SEQ ID NO: 382 - DNA, 39 bp, Artificial Sequence
  Synthetic polynucleotide
gctagcaccaaggggccatccgtcttccccctggcgccc

SEQ ID NO: 383 - protein, 14 aa, Artificial Sequence
  Synthetic peptide
ASTKGPSVFPLAPS

SEQ ID NO: 384 - DNA, 42 bp, Artificial Sequence
  Synthetic polynucleotide
gctagcaccaaggggccatccgtcttccccctggcgccctcc

SEQ ID NO: 385 - protein, 3 aa, Artificial Sequence
  Synthetic peptide
ASC

SEQ ID NO: 386 - DNA, 9 bp, Artificial Sequence
  Synthetic polynucleotide
gctagctgc

SEQ ID NO: 387 - protein, 4 aa, Artificial Sequence
  Synthetic peptide
ASTC

SEQ ID NO: 388 - DNA, 12 bp, Artificial Sequence
  Synthetic peptide
gctagcacctgc

SEQ ID NO: 389 - protein, 5 aa, Artificial Sequence
  Synthetic peptide
ASTKC

SEQ ID NO: 390 - DNA, 15 bp, Artificial Sequence
  Synthetic polynucleotide
gctagcaccaagtgc

SEQ ID NO: 391 - protein, 6 aa, Artificial Sequence
  Synthetic peptide
ASTKGC

SEQ ID NO: 392 - DNA, 18 bp, Artificial Sequence
  Synthetic polynucleotide
gctagcaccaaggggtgc

SEQ ID NO: 393 - protein, 7 aa, Artificial Sequence
  Synthetic peptide
ASTKGPC

SEQ ID NO: 394 - DNA, 21 bp, Artificial Sequence
  Synthetic polynucleotide
gctagcaccaaggggccatgc

SEQ ID NO: 395 - protein, 8 aa, Artificial Sequence
  Synthetic peptide
ASTKGPSC

SEQ ID NO: 396 - DNA, 24 bp, Artificial Sequence
  Synthetic polynucleotide
gctagcaccaaggggccatcctgc

SEQ ID NO: 397 - protein, 9 aa, Artificial Sequence
  Synthetic peptide
ASTKGPSVC

SEQ ID NO: 398 - DNA, 27 bp, Artificial Sequence
  Synthetic polynucleotide
gctagcaccaaggggccatccgtctgc

SEQ ID NO: 399 - protein, 10 aa, Artificial Sequence
  Synthetic peptide
ASTKGPSVFC

SEQ ID NO: 400 - DNA, 30 bp, Artificial Sequence
  Synthetic polynucleotide
gctagcaccaaggggccatccgtcttctgc

SEQ ID NO: 401 - protein, 11 aa, Artificial Sequence
  Synthetic peptide
ASTKGPSVFPC

SEQ ID NO: 402 - DNA, 32 bp, Artificial Sequence
  Synthetic polynucleotide
gctagcaccaaggggccatccgtcttccctgc

SEQ ID NO: 403 - protein, 12 aa, Artificial Sequence
  Synthetic peptide
ASTKGPSVFPLC

SEQ ID NO: 404 - DNA, 36 bp, Artificial Sequence
  Synthetic polynucleotide
gctagcaccaaggggccatccgtcttccccctgtgc

SEQ ID NO: 405 - protein, 13 aa, Artificial Sequence
  Synthetic peptide
ASTKGPSVFPLAC

SEQ ID NO: 406 - DNA, 39 bp, Artificial Sequence
  Synthetic polynucleotide
gctagcaccaaggggccatccgtcttccccctggcgtgc

SEQ ID NO: 407 - protein, 14 aa, Artificial Sequence
  Synthetic peptide
SSTKGPSVFPLAPC

SEQ ID NO: 408 - DNA, 42 bp, Artificial Sequence
  Synthetic polynucleotide
tctagcaccaaggggccatccgtcttccccctggcgccctgc

SEQ ID NO: 409 - protein, 14 aa, Artificial Sequence
  Synthetic peptide
AATKGPSVFPLAPC

SEQ ID NO: 410 - DNA, 42 bp, Artificial Sequence
  Synthetic polynucleotide
gctgccaccaaggggccatccgtcttccccctggcgccctgc

SEQ ID NO: 411 - protein, 14 aa, Artificial Sequence
  Synthetic peptide
ASAKGPSVFPLAPC

SEQ ID NO: 412 - DNA, 42 bp, Artificial Sequence
  Synthetic polynucleotide
gctagcgccaaggggccatccgtcttccccctggcgccctgc

SEQ ID NO: 413 - protein, 14 aa, Artificial Sequence
  Synthetic peptide
ASTAGPSVFPLAPC

SEQ ID NO: 414 - DNA, 42 bp, Artificial Sequence
  Synthetic polynucleotide
gctagcaccgcggggccatccgtcttccccctggcgccctgc

SEQ ID NO: 415 - protein, 14 aa, Artificial Sequence
  Synthetic peptide
ASTKAPSVFPLAPC

SEQ ID NO: 416 - DNA, 42 bp, Artificial Sequence
  Synthetic polynucleotide
gctagcaccaaggcgccatccgtcttccccctggcgccctgc

SEQ ID NO: 417 - protein, 14 aa, Artificial Sequence
  Synthetic peptide
ASTKGASVFPLAPC

SEQ ID NO: 418 - DNA, 42 bp, Artificial Sequence
  Synthetic polynucleotide
gctagcaccaagggggcatccgtcttccccctggcgccctgc

SEQ ID NO: 419 - protein, 14 aa, Artificial Sequence
  Synthetic peptide
ASTKGPAVFPLAPC

SEQ ID NO: 420 - DNA, 42 bp, Artificial Sequence
  Synthetic polynucleotide
gctagcaccaaggggccagccgtcttccccctggcgccctgc

SEQ ID NO: 421 - protein, 14 aa, Artificial Sequence
  Synthetic peptide
ASTKGPSAFPLAPC

SEQ ID NO: 422 - DNA, 42 bp, Artificial Sequence
  Synthetic polynucleotide
gctagcaccaaggggccatccgccttccccctggcgccctgc

SEQ ID NO: 423 - protein, 14 aa, Artificial Sequence
  Synthetic peptide
ASTKGPSVAPLAPC

SEQ ID NO: 424 - DNA, 42 bp, Artificial Sequence
  Synthetic polynucleotide
gctagcaccaaggggccatccgtcgcccccctggcgccctgc

SEQ ID NO: 425 - protein, 14 aa, Artificial Sequence
  Synthetic peptide
ASTKGPSVFALAPC

SEQ ID NO: 426 - DNA, 42 bp, Artificial Sequence
  Synthetic polynucleotide
gctagcaccaaggggccatccgtcttcgccctggcgccctgc

SEQ ID NO: 427 - protein, 14 aa, Artificial Sequence [sequence omitted]

SEQ ID NO: 428 - DNA, 42 bp, Artificial Sequence
  Synthetic polynucleotide
gctagcaccaaggggccatccgtcttccccgcggcgccctgc

SEQ ID NO: 429 - protein, 14 aa, Artificial Sequence
  Synthetic peptide
ASTKGPSVFPLSPC

SEQ ID NO: 430 - DNA, 42 bp, Artificial Sequence
  Synthetic polynucleotide
gctagcaccaaggggccatccgtcttccccctgtcgccctgc

SEQ ID NO: 431 - protein, 14 aa, Artificial Sequence
  Synthetic peptide
ASTKGPSVFPLAAC

SEQ ID NO: 432 - DNA, 42 bp, Artificial Sequence
  Synthetic polynucleotide
gctagcaccaaggggccatccgtcttccccctggcggcctgc

SEQ ID NO: 433 - protein, 14 aa, Artificial Sequence
  Synthetic peptide
ASPTSPKVFPLSLC

SEQ ID NO: 434 - DNA, 42 bp, Artificial Sequence
  Synthetic polynucleotide
gcatccccgaccagccccaaggtcttcccgctgagcctctgc

SEQ ID NO: 435 - protein, 14 aa, Artificial Sequence
  Synthetic peptide
APTKAPDVFPIISC

SEQ ID NO: 436 - DNA, 42 bp, Artificial Sequence
  Synthetic polynucleotide
gcacccaccaaggctccggatgtgttccccatcatatcatgc

SEQ ID NO: 437 - protein, 15 aa, Artificial Sequence
  Synthetic peptide
APTKAPDVFPIISGC

SEQ ID NO: 438 - DNA, 45 bp, Artificial Sequence
  Synthetic polynucleotide
gcacccaccaaggctccggatgtgttccccatcatatcagggtgc

SEQ ID NO: 439 - protein, 14 aa, Artificial Sequence
  Synthetic peptide
ASTQSPSVFPLTRC

SEQ ID NO: 440 - DNA, 42 bp, Artificial Sequence
  Synthetic polynucleotide
gcctccacacagagcccatccgtcttccccttgacccgctgc

SEQ ID NO: 441 - protein, 14 aa, Artificial Sequence
  Synthetic peptide
ASTKGPSVFPLVPC

SEQ ID NO: 442 - DNA, 42 bp, Artificial Sequence
  Synthetic polynucleotide
gcctccaccaagggcccatcggtcttccccctggtgccctgc

SEQ ID NO: 443 - protein, 14 aa, Artificial Sequence
  Synthetic peptide
GSASAPTLFPLVSC

SEQ ID NO: 444 - DNA, 42 bp, Artificial Sequence
  Synthetic polynucleotide
gggagtgcatccgccccaacccttttccccctcgtctcctgt

SEQ ID NO: 445 - protein, 14 aa, Artificial Sequence
  Synthetic peptide
GSTKGPSVFPLAPC

SEQ ID NO: 446 - DNA, 42 bp, Artificial Sequence
  Synthetic polynucleotide
ggcagcaccaaggggccatccgtcttccccctggcgccctgc

SEQ ID NO: 447 - protein, 14 aa, Artificial Sequence
  Synthetic peptide
ATTKGPSVFPLAPC

SEQ ID NO: 448 - DNA, 42 bp, Artificial Sequence
  Synthetic polynucleotide
gctaccaccaaggggccatccgtcttccccctggcgccctgc

SEQ ID NO: 449 - protein, 14 aa, Artificial Sequence
  Synthetic peptide
ASTKGFSVFPLAPC

SEQ ID NO: 450 - DNA, 42 bp, Artificial Sequence
  Synthetic polynucleotide
cctagcaccaaggggttctccgtcttccccctggcgccctgc

SEQ ID NO: 451 - protein, 14 aa, Artificial Sequence
  Synthetic peptide
ASTKGPSLFPLAPC

SEQ ID NO: 452 - DNA, 42 bp, Artificial Sequence
  Synthetic polynucleotide
gctagcaccaaggggccatccctgttccccctggcgccctgc

SEQ ID NO: 453 - protein, 14 aa, Artificial Sequence
  Synthetic peptide
ASTKGPSIFPLAPC

SEQ ID NO: 454 - DNA, 42 bp, Artificial Sequence
  Synthetic polynucleotide
gctagcaccaaggggccatccatcttccccctggcgccctgc

SEQ ID NO: 455 - protein, 14 aa, Artificial Sequence
  Synthetic peptide
ASTKGPSVLPLAPC

SEQ ID NO: 456 - DNA, 42 bp, Artificial Sequence
  Synthetic polynucleotide
gctagcaccaaggggccatccgtcctgcccctggcgccctgc

SEQ ID NO: 457 - protein, 14 aa, Artificial Sequence
  Synthetic peptide
ASTKGPSVYPLAPC

SEQ ID NO: 458 - DNA, 42 bp, Artificial Sequence
  Synthetic polynucleotide
gctagcaccaaggggccatccgtctaccccctggcgccctgc

SEQ ID NO: 459 - protein, 14 aa, Artificial Sequence
  Synthetic peptide
ASTKGPSVFGLAPC

SEQ ID NO: 460 - DNA, 42 bp, Artificial Sequence
  Synthetic polynucleotide
gctagcaccaaggggccatccgtcttcggcctggcgccctgc

SEQ ID NO: 461 - protein, 14 aa, Artificial Sequence
  Synthetic peptide
ASTKGPSVFPVAPC

SEQ ID NO: 462 - DNA, 42 bp, Artificial Sequence
  Synthetic polynucleotide
gctagcaccaaggggccatccgtcttccccgtggcgccctgc

SEQ ID NO: 463 - protein, 14 aa, Artificial Sequence
  Synthetic peptide
ASTKGPSVFPIAPC

SEQ ID NO: 464 - DNA, 42 bp, Artificial Sequence
  Synthetic polynucleotide
gctagcaccaaggggccatccgtcttccccatcgcgccctcg

SEQ ID NO: 465 - protein, 14 aa, Artificial Sequence
  Synthetic peptide
ASTKGPSVFPLIPC

SEQ ID NO: 466 - DNA, 42 bp, Artificial Sequence
  Synthetic polynucleotide
gctagcaccaaggggccatccgtcttccccctgatcccctgc

SEQ ID NO: 467 - protein, 14 aa, Artificial Sequence
  Synthetic peptide
ASTKGPSVFPLAFC

SEQ ID NO: 468 - DNA, 42 bp, Artificial Sequence
  Synthetic polynucleotide
gctagcaccaaggggccatccgtcttccccctggcgttctgc

The invention claimed is:

1. A multivalent antibody comprising four antigen recognition sites, wherein said multivalent antibody comprises four light chain polypeptides each comprising a light chain variable region, and wherein said multivalent antibody further comprises two heavy chain polypeptides each comprising two heavy chain variable regions linked to each other via a linker,
wherein each of said heavy chain variable regions is complexed with one of said light chain polypeptides to form the antigen recognition sites, wherein said multivalent antibody binds to two different epitopes,
and wherein said linker consists of a CH1 domain originating from an IgM or IgG4 subclass, or consists of a CH1 domain fragment of 14 or more amino acids in which position 14 of said fragment is a cysteine, said fragment originating from an IgM or IgG4 subclass and wherein all of said light chain polypeptides are the same.

2. The multivalent antibody according to claim 1, wherein the amino acid sequence of the linker is an amino acid sequence selected from the group consisting of SEQ ID NOs: 311 and 334-361.

3. The multivalent antibody according to claim 1, wherein the amino acid sequence of the CH1 fragment is an amino acid sequence selected from the group consisting of SEQ ID NOs: 362 to 375.

4. The multivalent antibody according to claim 1, wherein the N-end of one of the heavy chain variable regions is linked to the C-end of another heavy chain variable region via the linker.

5. The multivalent antibody according to claim 4, wherein the N-end of the linker is coupled to the C-end of one of the heavy chain variable regions and the C-end of the linker is coupled to the N-end of another heavy chain variable region.

* * * * *